United States Patent 11,446,398 (REGULATED BIOCIRCUIT SYSTEMS) - sequence listing, part 31

SEQ ID NO: 114044 - DNA, 2480 bp, Homo sapiens
  Payload ID: 2284
  Gene Symbol: CLIP4
  Gene Name: CAP-GLY domain containing linker protein family, member 4
  Uniprot ID: Q8N3C7
  ENST ID: ENST00000404424
  CDS Start-End: 333-2450
acattatctctgagagcactcgcagatgctgagcctgcagagacagagaaactggcagctgaccagggtcagggatggtcatgtattcaaatattgtgggttttagtcaagtgtgctccacccgattcaacaatgtgatgtgactgctcctagcaactattttgatatggtgaatgttgttaagcataggacctaagaagaggtggcagtctctttcctctccgcacttggcaggccacccactcattcctgataatcacatttaagagagctctggacaagctggaatgcatccaagagaatccctcaacatgctggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatat

SEQ ID NO: 114045 - DNA, 562 bp, Homo sapiens
  Payload ID: 2284
  Gene Symbol: CLIP4
  Gene Name: CAP-GLY domain containing linker protein family, member 4
  ENST ID: ENST00000438819
  CDS Start-End: 284-562
aatctttctgattctcttctgatggactgctgctctgcttgtatatgtgtctttagtttggtgcctctcatcttttagttatgctgactctagaaaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgca

SEQ ID NO: 114046 - DNA, 826 bp, Homo sapiens
  Payload ID: 2284
  Gene Symbol: CLIP4
  Gene Name: CAP-GLY domain containing linker protein family, member 4
  ENST ID: ENST00000449202
  CDS Start-End: 183-826
gacactcttgaaccatatctcaaatctgaagtctcctggcttcagtaaggcccttttatggggtccagacagtcctgaaccagcctgaagatgctagtggacatccccatttattactgctctgtgttaaagcatggaccaaggagtcttggaaaaaaaatcacaaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatt

SEQ ID NO: 114047 - DNA, 2311 bp, Homo sapiens
  Payload ID: 2284
  Gene Symbol: CLIP4
  Gene Name: CAP-GLY domain containing linker protein family, member 4
  ENST ID: ENST00000456385
  CDS Start-End: 288-581
agtaacgctttcttgttaccagatgacagagagtcaggctgtcagagttcacgactttaggtgcacagtttcaccctgtctggtccttgggagacggagaaggggtcaggagaaaacgtgggtgaagaggcagcaaagccgcaggagatatgaactaattgctcaacgtgggtgtagcacggattaggccttttacagcaagcgctgccagcagggaactggtggatgtactcttgaccacgctcggctggactctggggagcccaagacgggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgaggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtgactaaaactagtgcactgcatatattttatcttcatagaggtcagaactgttaataaaagttaaaggaattt

SEQ ID NO: 114048 - DNA, 2269 bp, Homo sapiens
  Payload ID: 2284
  Gene Symbol: CLIP4
  Gene Name: CAP-GLY domain containing linker protein family, member 4
  ENST ID: ENST00000415891
  CDS Start-End: 223-1710
agggaggcctgctgaagcctgccaccaccaccaggttttctgtaattggatctgcacaggggcctcagggagtgcagtatgaaaacacccatttccatgcactcccaaccaacacgctgaacaatctgtactcttggtgagaaagacccatgagggactgaaaattctttttctacgtgacactgagaagacagtcacatggtttgggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtga

SEQ ID NO: 114049 - DNA, 6111 bp, Homo sapiens
  Payload ID: 2285
  Gene Symbol: CIC
  Gene Name: capicua transcriptional repressor
  ENST ID: ENST00000160740
  CDS Start-End: 686-5506
gggggaggcgcggcggggggaggggagcgcgtagtagtggcggggcggggaggcggtggtggttcggcgcggggctcgctcggagcgcacggacgcacgcacgctggtccgtctgcccgcccggggccggaggtcgacccggcgctgagcctcgggcccggggcccggaaaggcggggcggcggcgccggcagccgggacgcgcggggccagagccgttacccgccggagctgcgagggagggagggaacgagcgagccagcgagcggggaagggagggggccgcccccgcgcacgcgcgtcgcgccccgccccgcctgccccgcctgccccgcccgccggactccgcgagggaggagggagagggagggggcggtgccgatggcccccgtgccgcgcgccccgtgacggcccccgcgcgcgccggggggcggggcggggccggtgcgcgctgacctcccccgccccccgggcggcgggaggcaggcggcgctgtgcgcaggcgcgcccggcagagacccccgcgtggggcggccggaggggggcggcgggggggggggcatgcggcgacggcctcccgctccccccgggcccaagcggcgacggccgaggagcgggctgcgggcggagcggcgtcggccgctgaggaggtgcgagcccctgccgggtcccccctgcgccggaccatgtattcggcccacaggcccctgatgcccgcgtccagcgcggcctcccgtggcctcggcatgttcgtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacaca

SEQ ID NO: 114050 - DNA, 927 bp, Homo sapiens
  Payload ID: 2285
  Gene Symbol: CIC
  Gene Name: capicua transcriptional repressor
  ENST ID: ENST00000573349
  CDS Start-End: 1-927
agctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaaggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcgggg

SEQ ID NO: 114051 - DNA, 5473 bp, Homo sapiens
  Payload ID: 2285
  Gene Symbol: CIC
  Gene Name: capicua transcriptional repressor
  Uniprot ID: Q96RK0
  ENST ID: ENST00000575354
  CDS Start-End: 41-4867
ggaggtgcgagcccctgccgggtcccccctgcgccggaccatgtattcggcccacaggcccctgatgcccgcgtccagcgcggcctcccgtggcctcggcatgttcgtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcagcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacagcaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacacac

SEQ ID NO: 114052 - DNA, 1304 bp, Homo sapiens
  Payload ID: 2285
  Gene Symbol: CIC
  Gene Name: capicua transcriptional repressor
  ENST ID: ENST00000576505
  CDS Start-End: 1-961
ggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaa

SEQ ID NO: 114053 - DNA, 601 bp, Homo sapiens
  Payload ID: 2285
  Gene Symbol: CIC
  Gene Name: capicua transcriptional repressor
  ENST ID: ENST00000571942
  CDS Start-End: 169-601
ggctgctccagctgttgcaggtccattcaccattttgtgtgttggagtaaaaaaaaaagggagaatcgagagggagagccggagggggggcggggagggaccggaccggaccgagccggggccacggccccccgccccgaaaccccgccgagcccaaggtggacaaaaatgaagccaatgaagaaggcatgcactggcctttcaggtcctggcagtggcagcaagtcccccccagccaccagggccaaggctctgaggcggcgaggggctggggagggtgacaagccagaggaggaggatgacgaggcacagcagccgcaaccacagtccgggcccgaagaggctgaggaaggggaggaggaggaggctgagcggggccctggggctgaaggtcctccactggagctgcaccctggcgacccggctccaggcccagcagaggaccccaaaggggatggggaggcaggccgctgggagccctcactcagccgcaagacagccacgttcaagtctcgagcgcccaagaagaagtatgtggaggagcacggagctggcagcagtggggtggctggggcccctgaagagcgggtgcggacccctg

SEQ ID NO: 114054 - DNA, 8218 bp, Homo sapiens
  Payload ID: 2285
  Gene Symbol: CIC
  Gene Name: capicua transcriptional repressor
  ENST ID: ENST00000572681
  CDS Start-End: 69-7613
gtgccgctaccgctgccactgagaggagccaccggcgacgccagagccaggaatacgggtggacaaaaatgaagccaatgaagaaggcatgcactggcctttcaggtcctggcagtggcagcaagtcccccccagccaccagggccaaggctctgaggcggcgaggggctggggagggtgacaagccagaggaggaggatgacgaggcacagcagccgcaaccacagtccgggcccgaagaggctgaggaaggggaggaggaggaggctgagcggggccctggggctgaaggtcctccactggagctgcaccctggcgacccggctccaggcccagcagaggaccccaaaggggatggggaggcaggccgctgggagccctcactcagccgcaagacagccacgttcaagtctcgagcgcccaagaagaagtatgtggaggagcacggagctggcagcagtggggtggctggggcccctgaagagcgggtgcggacccctgaggaggccagtggcctgggggtgcctccacggccacccacctccactcgttcctcctccactgacacagccagcgagcactcggcggacctggaggatgagccggctgaggcttgtggtccaggcccttggccccctggcagcaccagtggcagctatgacctgcggcagctgcggtcccagcgggtgctggctcggcgtggtgatggccttttcctgccggctgtggtgcgccaggtgcgccgaagccaggacctgggcgtgcagttccctggtgaccgagccctgactttctatgagggggtgccaggcgctggtgtggatgtagttttggatgccacacccccaccaggtgccctggtggtgggcacagctgtctgtacctgtgtggagcccggcgtggctgcctaccgggaaggtgtggtggtggaggtggccaccaagccagctgcctacaaggtccgtctcagccctggccccagctcccagccaggcctaccaggcagcctcccgcagcccccacagccactgcaccgtgagccagaggaggctgtgtgggtggcccgctccagcctacgcctgctgcgccccccctgggaacctgagaccatgctgaggaagccccctacaggccctgaggaagagcaggcagagcctggggccaccctgccaccctgccctgctgccctggaccccaaacagcccgaggatgctgaggtctctaagatcagctttggtggcaacctgggtactcactgtgaggagggcgaggagaagcaccctccagccctgggtaccccagccctgctcccactgcccccaccccagctcctgtcaccaccacccaagtctccagcctttgtgggccccggccgccctggcgagcagccctcgccctgccaggaggggagccagggcggcagccgcagcagcagcgtggcctccctggaaaaggggacagcaccggcagcccgggcccgcacgccactgacagccgcccagcagaagtacaagaagggcgatgtggtctgcacacccagcggaatacgaaagaagttcaacggcaagcagtggcgccggctgtgctcacgagatggctgcatgaaggagtcacagcggcgaggctactgctcacgccacctgtccatgcgaaccaaagagatggaaggcctggcagacagtgggcctggcggggcgggccggcccgcggccgtggcagcccgtgagggcagcacggagtttgactggggtgatgagacgtcgagggacagtgaggccagcagtgtggcggctcgtggagactcacggccacgcctggtggcccctgctgacttgtcacgctttgagttcgacgagtgtgaggcggccgtgatgctggtgtcgctgggcagctcgcgctcaggcacgccctccttctcacccgtctccactcaatcgcccttctcgccagccccatcaccctcaccctcaccactcttcggcttccgccctgccaactttagccccatcaatgcctcaccagtcatccagcgcactgcagtccgcagtcgccacctgagcgccagcacccctaaggcaggcgtgctgacgccaccagacctgggcccccacccaccgccacctgccccccgagagcgccactcctctggaatcctacccaccttccagaccaacctgaccttcaccgtgcccatcagccctgggcgacggaagacagagctgttgccgcatccaggggccttgggggcccctggcgcagggggtggaggagccgccccagactttcccaagagtgacagcttagactctggtgtggactcagtgtcccacacacctacaccctccacgccggctggcttccgggccgtgtcccctgctgtgcccttctctcgctcccgccagccctcaccattgctgctgttgccaccccctgccggcctgacctcggatccagggccctctgtgcgcagggtgcctgctgtgcagcgggactcacctgttattgtccgcaaccctgatgtgccactgccctccaaattccctggggaggtgggcactgctggtgaggtgcgggctgggggacctgggcggggctgccgtgaaaccccagtgccccctggggtggccagtgggaagcctggcctgcccccacctctgccagcccccgtgcccatcaccgtgcctccagctgcaccaactgccgtggcccagccgatgcccgcctttggcctggcttcttcaccctttcagcctgtggccttccacccctcacctgctgccctgttgcccgttttggtgcccagcagctataccagccaccctgcccccaagaaggaagtcatcatgggccggcctggaacagtgtggacgaatgtggaacctcgctctgtggctgtgttcccttggcactccttagtccccttcctggcacccagccagcctgacccctccgtgcagccgagcgaggcccagcaacctgccagccacccagtggcctccaaccagagcaaagaacctgctgagtcggcagctgttgctcatgaacggccaccaggtgggacagggagtgctgaccctgagcggccccctggagccacatgccctgagagcccaggacccggacccccacaccctttgggggtggtggaatctggtaagggtccgcctcccaccacggaggaggaggcctccggccccccaggagagccccggctggacagtgagacagagagtgaccatgatgatgccttcctctccatcatgtctcctgagatccagttgcctctaccgcccggaaaacgtcggacccagtccctcagtgccctacccaaggaacgggactcatcttctgagaaggatggacgcagccccaacaagcgggagaaggaccacatccggcggcccatgaatgccttcatgatcttcagcaagcggcaccgggccctggtccaccagcgtcatcccaaccaggacaaccggaccgtcagcaagatcctgggcgagtggtggtatgccctggggcccaaggagaagcagaagtaccacgacctggccttccaggtgaaggaggcccacttcaaggcccacccagattggaagtggtgcaacaaggaccgaaagaagtccagctcagaggccaagcccacgagcctggggctggcaggagggcacaaggagacgcgggagcggagcatgtcggagacgggcactgctgctgcccctggggtgtcctctgagctcctgtccgttgcagcccagacactcctgagctcagacaccaaggctccggggagcagctcctgtggggcagaacggctacacacagttgggggacctggctcagcccggccccgagctttctcccacagcggggtacacagcctggacggcggagaagtagacagtcaggcgctacaggaactgacgcagatggtgtctggccctgcatcgtactctggcccaaagccttctacccagtatggagctccaggaccctttgcagcccctggtgagggaggtgccttggcggccactgggcggcccccgctgctgcccacccgagcttctcgttctcagcgtgcggccagtgaggacatgacgagtgatgaggagcgcatggtcatctgtgaggaggaaggggatgatgatgtcattgctgacgatggcttcggcaccactgacattgatctcaagtgcaaggagcgggtgaccgacagcgagagtggggacagctctggggaggacccagagggcaacaagggctttggtcggaaggtgttttcacctgtgatccgttcctcctttacccactgccgccccccactggaccctgagcccccagggcccccggatcctcctgtagcctttggcaaaggctatggttccgccccatcctcctctgcgtcctcgcctgcttcctcctcagcctcggcagccacctccttctcactgggctcaggaaccttcaaggcccaggagtctggtcagggcagcacagcgggccccctacggcccccaccccctggggctgggggtccagcgacaccttccaaggcaacccggttcctcccaatggatcctgccaccttccggcgcaagagacccgaaagtgtgggtggcctggagccaccaggcccctcagtcatcgcggcccctcccagcggaggaggaaacatcctgcagacactggtgctgcccccaaacaaggaggagcaagagggcggcggagccagagtgccctccgcccccgccccatcactggcctatggggccccagcagctcccctgtcccgtcctgccgccaccatggtcaccaatgtggtgcggcctgtcagcagcactcctgtgcccatcgcctctaagcccttccccacctctggccgggctgaggcgtctccaaatgacacagcaggtgccaggactgaaatgggcactgggtctcgggtgcctgggggctccccgctgggtgtcagcttagtgtattcggacaagaagtcggcagcagccacctcaccagccccacacttggtggctggacccctgctgggcactgtggggaaggcgcctgccactgtcactaacctactggtgggcaccccggggtatggggcccctgcgccccctgctgtccagttcattgcccagggggcccctggtggtgggaccactgcgggctcaggagcaggtgctgggagtggccccaatgggccagtacccctgggcatcctgcaaccaggtgccctgggcaaggctgggggaatcacccaggtacagtacatcctgcccacgctgccccagcagcttcaggtggcacctgccccagcaccagcccctgggaccaaggcagcggctcccagcggccctgcacccaccaccagcatccgtttcaccctcccaccgggcacttccaccaacggcaaagtcctggctgccactgcacccactcctggcatccccatcctgcagtctgtaccctccgccccaccccccaaagcccagtcagtttctcccgtgcaggccccgcccccgggtggctcagcccagctgctgcctgggaaggtcctagtgcctctggccgcccctagcatgtcagtgcggggtggaggggccggccagccactgccactggtgagcccgcccttctcagtacctgtgcagaatggtgcccagccccccagcaagatcatccagctgaccccggtgcctgtgagcacacccagcggcctggtgccgcccctgagcccagccacactccctggacccacctctcagcctcagaaggtcctgttgccctcctccaccagaatcacctatgtgcagtcagcgggcgggcacgcgctgcccctgggtaccagccctgcgtccagccaggctggaacagtcacctcgtacgggcccacgagctctgtagctctaggcttcacctcgctggggcccagcggccccgccttcgtgcagcccctgctctcaggccaagccccactgctggctcccggtcaggtgggcgtgtcacctgtgcccagtccccagctgccgcctgcctgtgcagcccccggaggtcctgtcataacagcattttactctggcagccctgcacccacctcctcagcacccctggcccagccatcccaggcccccccaagcctggtctacactgtggccaccagcacaaccccacctgcagccaccattctgcccaagggcccgccagcccctgccactgccaccccagccccgactagccctttccccagcgccacaggttccatgacctacagcttagtggcccccaaggcccagcggcccagcccgaaggccccccagaaagtgaaggcagccatcgccagcattcccgtggggtcctttgaggcaggtgcctctgggcggcctggccctgcaccccggcagcctctggagcctggcccagtccgagagccaactgccccagagtctgagcttgaggggcagcccacaccaccagcccctccacccctgccagagacctggactcccacggcccggagcagccccccactgcccccacctgctgaggagcggaccagcgccaagggccctgagaccatggccagcaaattccccagctcatcttcagactggcgcgtccctgggcagggcctggagaatcgtggggagcctcccactcctcccagcccggccccagctccagctgtagcccctggtggcagcagcgagagcagcagtgggcgggcagccggggacaccccggagcgcaaggaggcggctggtactggcaagaaggtgaaggtgcggcccccgcccctgaagaagacctttgactctgtggacaaggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggagggggctccccagccctcccccccacccccaggtccctccacagctgccacaggcaggtgagggacccctgagaagatgccaggacttatagtaccccctcaggacatggacagtatgtgggggcaggaaggttatctcctcccgggtaaagccatttcgtcctctccagtttggggcggaatgaggcctgctcctcttgtaaatacccccttccctcgaagctccctcccggtgctggggggcagctgaggggctgcaggggcagtctccctcctccaagcccctgtacataacctggagcgtgtgaccttcagagcttttcactttatgcaaaatggctcctgtgagggctgcaagctggagggtggtgcaggccttgggccacagggaggcgcctgtggaatagggggagttcatgcaccccttttttccccagaggggctggactcaggttagtttgggggtgggggctcctgcactttgccacaggcacggggagggttttctcctcaccccctctgccctcccaacttgggttgtactttctaagaaggtgattccccctgcccttgcccccttccccagaacaaaacatgttgatcatgtgcaatatttcttactgtgccgagaagccgcaatgagcgagattaaagctgtttaacaca

SEQ ID NO: 114055 - DNA, 846 bp, Homo sapiens
  Payload ID: 2285
  Gene Symbol: CIC
  Gene Name: capicua transcriptional repressor
  ENST ID: ENST00000575287
  CDS Start-End: 1-435
ccggagcgcaaggaggcggctggtactggcaagaaggtgaaggtgcggcccccgcccctgaagaagacctttgactctgtggacaacagggtcctgtcagaagtggacttcgaagagcgctttgctgagttgcctgagtttcggcctgaggaggtgctgccctcccccaccctgcagtctctggccacctcaccccgggccatcctgggctcttaccgcaagaagaggaagaactccacggacctggattcagcacccgaggaccccacctcgcccaagcgcaagatgagaagacgctccagctgcagctcggagcccaacacccccaagagtgccaagtgcgagggggacatcttcacctttgaccgtacagccttgccatgctgcctgtgccctgcacaggtacagaagccgaggacgtgcttggggagctagagtatgacaaggtgccatactcctccctgcggcgcaccctggaccagcgccgggccctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccgctgctgcccctgcccccactcccagccccgcagggggccctgaccccacctcacccagctcggactctggcacggcccaggctgccccgccactgcctccacccccagagtcggggcctggacagcctggctgggaggggg

SEQ ID NO: 114056 - DNA, 3020 bp, Homo sapiens
  Payload ID: 2286
  Gene Symbol: CAPZA1
  Gene Name: capping protein (actin filament) muscle Z-line, alpha 1
  Uniprot ID: P52907
  ENST ID: ENST00000263168
  CDS Start-End: 673-1533
gggaatcctgggatagtggcggacctgaagttggcctctgtgaaggctgagtcctggggaaccgggaccgagaagatttcgaaggtggaggagcgtgtctcaagattggggctacctgttctttcgtggggcagggaaggggcggacagcagcgcctattctggaggaactggactgagatgtgaccccgaagtgttaccgcttccaaacgaaatgagggtcacctttcacaccgccccccccccggggttggaaaagccaccgatcgttccagctgccgagcagctcttaaagctttggattcggctgtcgtggagataacgggcaccagaaaaacttgtaggagtagcaacagctatttggtcggatggaggccagaagccaagaataatcgaaacacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacatgcatttgcccagtataacatggatcagttcacgcctgtgaagatagaaggatatgaagatcaggtcttaattacagagcacggtgacctgggtaatagcagatttttagatccaagaaacaaaatttcctttaaatttgaccacttacggaaagaagcaagtgacccccagccagaagaagcagatggaggtctgaagtcttggagagaatcctgtgacagtgctttaagagcctatgtgaaagaccattattccaacggcttctgtactgtttatgctaaaactatcgatgggcaacagactattattgcatgtattgaaagccaccagtttcagcctaaaaacttctggaatggtcgttggagatcagagtggaagttcaccatcacaccacctacagcccaggtggttggcgtgcttaagattcaggttcactattatgaagatggcaatgttcagttggttagtcataaagatgtacaggattcactaactgtttcgaatgaagcccaaactgccaaggagtttattaaaatcatagagaatgcagaaaatgagtatcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatctttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaggtgacccattgagctgtgtatgcatttttgtttatttcaataaaatatatttgtattatttgtccttcatactatccatccataccacactatcttctgtatcaggtagtctaatagaaatatacctgttttgttctaaaattg

SEQ ID NO: 114057 - DNA, 5182 bp, Homo sapiens
  Payload ID: 2287
  Gene Symbol: CAPZA2
  Gene Name: capping protein (actin filament) muscle Z-line, alpha 2
  Uniprot ID: P47755
  ENST ID: ENST00000361183
  CDS Start-End: 140-1000
cccggggtgcgcgtgcgcggcggcctgagcggcgggcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattagagggaaagcattttctatatcaattgtgtttaaacctttcaagaaggttatttagctagcttagtgttgaactaaattttttttaaacaaggcaaggtctaatgctgttttgagattctgaaattaatgaaaatacttatttcagaaatgcatttaatgctttttttcttgtgacagttacgcaaatcagcttgaattccatatgtccctgagttatttttatcataaagccacaaatgtattataacaaggcaaattgtaatatatataatcctgaactcatgaccatgtctcggtttattttttttttcttggattgaaaagtactgaaattcaatgtgacattaaaatgcaaattttcctatttatttgagtagaaaatcacttaccagtgagcatatatattttaaaatactttctttggatattgtaattcttaactggttgtaaattagaaaagctgggattacatatggtgtgcggttacagtctaaattttttcatcctcctatgcatcataagcatgtttgtaatattttcaaaaatagttctactgatgctacaggaatttcaagcctgtggtgaatgttagtatttaccatagggagtgaagtggagttatggtttcattcaatagagtattgctgattatacttgagtggaatcctttcctcacgtactcccacagacgtctgggcctggaaattttttttttattttattttattgtttttttttttagaaaaacaccacttttattatgtacaataaaatatttcattagcttgaattgtatagatttttaaaaattcaatgaaagcatgttgtttaatttctttttaaaatcactgttgggctttgaaagcattgagaatataatatgaaattatgacattttgtctaaatcatcttttctttagttttaaaatacaagttttggcacattgggattcctaaagaaaatgaattggtaacattaattatctgttcctttttaaaatatatatatttgaaagtttgatgatggtgaactaaatactagatctaattgacaagcttagttgtatcagttaggccatcatgagtttctatcccatgaaagtcatcaatttcctatctctgttctagtctggaatgcattactgaaaatgtatgcaactgtttttaaggtgatttgcttgtgagacggaagatttatcaaaaataatttagaacaggctgggcgcggtggctcacatctgtaatcccagcactttgggaggccgaggcgggtggatcacggggtcaggagattgagaccaccctgactaacacagtgaaaccctgtctctactaaaaatacaaaaaattagccgggtgtggtgacaggcgcttgtagtcccagctactcgggaggctgaggcaggagaatggcgtgaacccgggaggcggagctcgcagtgagccgagatcgcgccactgcactccagcctgggtgacagagcaagactctgtctcaaaaaataataataataataataataatataatttagaacagtctgaaataatgatggcacagaatagtcttttatagtataagaatggcatttattaggcagggcacagtggctcacacctgtaatcccagcactttgggaggccgaggcgggtggatcacgaggtcaggagttcgagaccagcctgaccaacatgctgaaaccccgtctctactaaaaacaaaaaaaaattagccggggatggtgatgcgcgcctgtaatcccaactactcaggaggctgagacaggagaatcatttgaacccgggaggtggaggttgcagtgagcagagatcgagccactgtactccagcctgggtgacacagggagcctctgtctcaaaataataataataataaaagaatggcatttattaaagtgaaagaagaatggaaacccagagtatcctatagctcagggatgtaattttagtaggagacattatggctgctttgctgagtaggctgaagtgtggtggcaaaggcataatcagggagaacagctaggagactactgcagtaatctagttgagagagcatgctggcttggactgaggtggttgctgtagaggtggtataaagcagtgaggtctaggtatatcctaaaggtaaaatcagcaagacctggggagagtttggtcatggagtgtgagataaagagaaccatgtctggggctggagaaattgaggaagattcttgtaggagcaagttggtttggagaagaaggctggtcaggagctcagttttctattcaaaggagaaatatctcatgtagcagttagatacaggagacaggaactagaggaaagctctgggctagaagaatgggaaagtgcatgaacctggaaacaattttataggcagacaggatgaaggacctcaaggttagtgataatgaatttaaagtaaatgagaccaatgatgagcatggctgtatgtttttcttcaaccgtgtaaagctgtttgggtgcaggcatagagtagatgaaataaatttcaccagggctgtggttttgcccagagtgaatgaccacatgaagaggggcagggtatgatgatggtctgtggaatttcagctgggtaagcagggaagtgagggcttgagacggggggagggatagtgaaaatgtacaaccagtggattataggtgtgttaaagtaggggaactagaaagaatgacctggaaatgtaagaagtgggccgggcgcagtggctcatgcctgtaatcccagcactttaggaggctgaggtgggtggatcatgaggtccagagatcaagaccatcctggccaatatggtgcaaccccatctctactaaaaatacaaaaattagctgggcgtggtggtgtgcctgtagtcccagctactagggaggctgaggcaggagaatcgcttgaacccaggatgcgaaggttgcagtgagccgagattgtgccactgcactccaggctggcgacagagcgagactctgtcccaaaaaaaaaaaaaagtggtgggctggccacgatggctcacgcctataatcccagcactttgggaggccacggcaagtggatcatttaaggtcaggagttcaagaccagtctggctaatatgatgaaaccccttctgtattaaaaatacaaatattagccgggcatggtggcacatgcctgtagtcccagctactcaggaggctgaggcaggagaatctttgaacccaggaagtgacagttacaacgagcggagactgtgccacttcactgcagcctgggtgacagggtgagagtctgtctcaaaaaaagaaaaaggaaatgtaagaagtggtgattggagaatggtgtgcttaattaaaattgaggttttgaggagttactagtaatgacaaatatgaccaacggagtgactggctgaggggagagaggagaggacttaagcaactgtgccactcagcattggaaaggtcacctctgtgacattaaaatcaagaattctgatagaagtaagagttctggcatgagtggtgcttttccagagtacacttggatatatgattacattttaataagttatataaatatgcagatattcatgcggcttttcctcatttgggattttggaaactaaaatagtagtaagagcattaaaaaaaagatgtcctggaa

SEQ ID NO: 114058 - DNA, 1214 bp, Homo sapiens
  Payload ID: 2287
  Gene Symbol: CAPZA2
  Gene Name: capping protein (actin filament) muscle Z-line, alpha 2
  ENST ID: ENST00000426421
  CDS Start-End: 13-537
gccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttgctgctgtttttatttttaaggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaaaatgaataccagactgccatcagtgagaattatcagacaatgtcggacactactttcaaagccttacgtcgacagttgccagttacacgcactaagattgattggaacaagatccttagctacaagattggcaaagagatgcagaatgcataagatgaacattgcatgaccggatcattttagtgtctttgcgttaaaaaatcattgcaaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaa

SEQ ID NO: 114059 - DNA, 814 bp, Homo sapiens
  Payload ID: 2287
  Gene Symbol: CAPZA2
  Gene Name: capping protein (actin filament) muscle Z-line, alpha 2
  ENST ID: ENST00000449080
  CDS Start-End: 26-139
gccgcggtttgtcgccagaaggaagatggcggatctggaggagcagttgtctgatgaagagaagactaagtcagtgctacactttgaggattttgaaagcagagggcctggaaagttggccaatttttttttaaagtaaatgaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttggaatggtcgttggaggtcagaatggaagtttacaatcactccttcaaccactcaagtggttggcatcttgaaaattcaggttcattattatgaagatggtaatgttcagctagtgagtcataaagatatacaagattccctaacagtgtctaatgaagtgcaaacagcaaaagaatttataaagattgtagaagctgcagaa

SEQ ID NO: 114060 - DNA, 324 bp, Homo sapiens
  Payload ID: 2287
  Gene Symbol: CAPZA2
  Gene Name: capping protein (actin filament) muscle Z-line, alpha 2
  ENST ID: ENST00000484325
  CDS Start-End: 222-324
ctcaagatcgaggggcttcaggacagtgaacatagtcttgctctgtcacccaggctggagtacagtggcgcgacctcggctgactgcaacctccgtctcccgggttgcagggacagggacaacctccgcctctcgggttgcaatgacttctgcaactctcctgcctcagcctcccgagtagctggtattacaggtgcgtatagcagcaaaattcatcattcatgcccctcctggagaatttaatgaggttttcaatgatgttcggttactgcttaataatgacaatcttctcagggaaggagcagcccatgcatttgcacagta

SEQ ID NO: 114061 - DNA, 809 bp, Homo sapiens
  Payload ID: 2287
  Gene Symbol: CAPZA2
  Gene Name: capping protein (actin filament) muscle Z-line, alpha 2
  ENST ID: ENST00000490693
  CDS Start-End: 13-453
gccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtaagtcatcagtagcagctttgtgtgtgtgttttgtgtaaatgtgagtctttagcgtctcttaaaatttacagtaacttacagaattgacattgtataatttgtcatttttttccttaaatatttctaagaatgtttactattttttcaagaaattctggataataaatagatatactaggatggcttaaaatagagaaatggttgtaccttgatttaaatccatgtagaaattctaatacattgattaaaggagcaggatatggtgagattctgtaatcttatgttcatgactcgtctcagtttagatcaaagttatttttattaagtcacagaaatcttagaacaaataaaattacttggaagtaaaa

SEQ ID NO: 114062 - DNA, 164 bp, Homo sapiens
  Payload ID: 2287
  Gene Symbol: CAPZA2
  Gene Name: capping protein (actin filament) muscle Z-line, alpha 2
  ENST ID: ENST00000464223
  CDS Start-End: 62-164
ctcaagatcgaggggcttcaggacagtgaacatgtgcgtatagcagcaaaattcatcattcatgcccctcctggagaatttaatgaggttttcaatgatgttcggttactgcttaataatgacaatcttctcagggaaggagcagcccatgcatttgcacagta

SEQ ID NO: 114063 - DNA, 525 bp, Homo sapiens
  Payload ID: 2287
  Gene Symbol: CAPZA2
  Gene Name: capping protein (actin filament) muscle Z-line, alpha 2
  ENST ID: ENST00000628758
  CDS Start-End: 1-525
atgattgatgtcagataccagatagataacaaaaagatggtgcgtatagcagcaaaattcatcattcatgcccctcctggagaatttaatgaggttttcaatgatgttcggttactgcttaataatgacaatcttctcagggaaggagcagcccatgcatttgcacagtataacttggaccagtttactccagtaaaaattgaaggttatgaagatcaggtattgataacagaacatggcgacttgggaaatggaaagtttttggatccaaagaacagaatctgttttaaatttgatcacttaaggaaggaggcaactgatccaagaccctgtgaagtagaaaatgcagttgaatcatggagaacttcagtagaaactgctctgagagcttacgtaaaagaacattacccgaatggagtctgcactgtgtatggcaaaaaaatagatggacagcaaaccattattgcatgcatagaaagccatcagttccaagcaaaaaatttttgctgctgtttttatttttaa

SEQ ID NO: 114064 - DNA, 1087 bp, Homo sapiens
  Payload ID: 2288
  Gene Symbol: CAPZA3
  Gene Name: capping protein (actin filament) muscle Z-line, alpha 3
  Uniprot ID: Q96KX2
  ENST ID: ENST00000317658
  CDS Start-End: 169-1068
gacctcatcaggaggctcagaccttgccagactgcctgctttcatggatagacataaaaaccttcagcttgaatgttaacaccttgatgggaaaggtggctcatggaatgttttcttatcctttgaacactcctcatttcagaagctttgcttctgttgcaaccaaacatgacacttagcgtgctgagcaggaaggacaaggaaagagtaattcgcagactgttattacaggcccctccaggggaatttgtaaatgcctttgatgatctctgtctgcttatccgtgatgaaaaacttatgcaccaccaaggtgagtgtgcaggccaccaacactgccaaaaatattctgtaccactctgcatcgatggaaatccagtactcttgtctcaccacaatgtaatgggcgactaccgattttttgaccatcaaagcaaactttctttcaaatatgacctgcttcaaaatcagctgaaagacatccaaagtcatggtatcattcagaatgaggcagaatacctgagagttgttcttctgtgcgccttaaaactgtatgtgaatgaccactatccaaaaggaaattgcaacatgctgagaaaaactgtcaaaagtaaggagtacttgatagcttgcattgaagatcacaactatgaaacaggagagtgctggaacggactttggaaatctaaatggattttccaagttaacccatttctaacccaagtaacgggaagaatatttgtgcaagctcacttcttcaggtgtgtcaaccttcatattgaaatatccaaggacctgaaagaaagcttggaaatagttaaccaagctcaactggctctaagttttgcaaggcttgtggaagagcaagagaacaaatttcaagctgcagtcttggaagaattacaggagttatccaatgaagccctgagaaaaattctacgaagggatcttccagtgacccgcactcttattgactggcacaggatactctctgacttgaatctggtgatgtatcctaaattaggatatgtcatttattcaagaagtgtgttgtgcaactggataatataaagaattgctcctggtaact

SEQ ID NO: 114065 - DNA, 858 bp, Homo sapiens
  Payload ID: 2289
  Gene Symbol: CAPZB
  Gene Name: capping protein (actin filament) muscle Z-line, beta
  Uniprot ID: P47756
  ENST ID: ENST00000264202
  CDS Start-End: 40-858
actgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaa

SEQ ID NO: 114066 - DNA, 2068 bp, Homo sapiens
  Payload ID: 2289
  Gene Symbol: CAPZB
  Gene Name: capping protein (actin filament) muscle Z-line, beta
  ENST ID: ENST00000264203
  CDS Start-End: 495-1277
gtggaagcgccgggccctgctgcgggggggagagccactgacgccgggaccgggaccgccgccgccgccgccaccatgctccatgcctgaccgtgactcgcatctcgccaggccagtgcatttcctcttctggctgtcatcggaattttcaagtgtcaagaccccactttgttcctgttgtcctggttccggctttgggaagcatgacctttcaggcctgctcagagacaccgcagtgcactttgtgcgttatcagccttacagagactctacggtcaggagtttttgtggcaatggaactgctggggtttcatctgcaaatgaaaaccatctggccagctgcttgggtcagatggaaaccagatgggagaagtcaggagcgggcagcgagcagcctggggcagcgtccctagtcacgtcatgtttccacttcctcttgccccctcgcctcccctgcctgcaaaacgattgttattaacccatcacctcctccaatgcccaggcagttccaggatacagggttctctcgcccaggccttggccagcccagaagatgtgacccagaacctagaaagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgcagtt

SEQ ID NO: 114067 - DNA, 1686 bp, Homo sapiens
  Payload ID: 2289
  Gene Symbol: CAPZB
  Gene Name: capping protein (actin filament) muscle Z-line, beta
  Uniprot ID: P47756
  ENST ID: ENST00000375142
  CDS Start-End: 48-881
ggagagccactgacgccgggaccgggaccgccgccgccgccgccaccatgagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgagatctattgatgctatccctgacaaccaaaagtttaagcagttgcagagggagctctctcaagtgctgacccagcgccagatctacatccagcctgataattaagccgatccaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatactta

SEQ ID NO: 114068 - DNA, 1568 bp, Homo sapiens
  Payload ID: 2289
  Gene Symbol: CAPZB
  Gene Name: capping protein (actin filament) muscle Z-line, beta
  ENST ID: ENST00000375144
  CDS Start-End: 35-817
gagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggtttttgttcacccgggccccccgtcttcctccctgtccccccatttataggcataaaatccactgtctgccagcctcccttccctcccacctttttggtacattggtgtaaaaaatgtaaaacaaaaaaattttatgaactaactgtggtgtgtgaaagagagaagaaaaactggaaatcttattccgtgtgtgtttgggagttgcttggggttgggggtcgtggggacaggggacagctctgggagcagaggtggccctcggtgccgtcctgcgcagactctcccgtcccacggaggccgcggggtgggggctggggggggtgccgccgaccgttccgctcttccggccaggtgcttttctgtcaatttctatggaatgcaaaaggaggtttttgttttattttgtttttttgtaaagcttaagaaaaaaatctacatcttatacttgagcctccatacttaaaaaaagaaaagaaaagaaatcaataaaaagaaactggggcgca

SEQ ID NO: 114069 - DNA, 1462 bp, Homo sapiens
  Payload ID: 2289
  Gene Symbol: CAPZB
  Gene Name: capping protein (actin filament) muscle Z-line, beta
  ENST ID: ENST00000433834
  CDS Start-End: 386-1291
tccctgtacctggggcgcgccttctttgcagcctttggggagcgaggggagctctccatcagggatggggtggtcccggtgctgtgccttctcagttgccgcttctagggaggccgcctaggagccagcgagggaagggcgggcatcggtgtgcccagaaggcagcgcgctgctctgcgggcccttctcgaggctgccgccgtgggtgctgtgcgtgcgaagcattctgcagggcaggccggggtccacggcgcccgggcctgagtgggagccgaggggcgaggatgggtggcccacaggacaaggatgaacgcacaatcgcccttgtgaggccgtggccttggggggccaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggtccccagtctatgtgaggatctcctgtcttctgttgaccagccactgaaaattgccagagacaaggtggtgggaaaggattaccttttgtgtgactacaacagagatggggactcctataggtcaccatggagtaacaagtatgaccctcccttggaggatggggccatgccgtcagctcggctgagaaagctggaggtggaagccaacaatgcctttgaccagtatcgagacctgtattttgaaggtggcgtctcatctgtctacctctgggatctggatcatggctttgctggagtgatcctcataaagaaggctggagatggatcaaagaagatcaaaggctgctgggattccatccacgtggtagaagtgcaggagaaatccagcggtcgcaccgcccattacaagttgacctccacggtgatgctgtggctgcagaccaacaaatctggctctggcaccatgaacctcggaggcagccttaccagacagatggagaaggatgaaactgtgagtgactgctccccacacatagccaacatcgggcgcctggtagaggacatggaaaataaaatcagaagtacgctgaacgagatctactttggaaaaacaaaggatatcgtcaatgggctgaggtctgtgcagacttttgcagacaaatcaaaacaagaagctctgaagaatgacctggtggaggctttgaagagaaagcagcaatgctaaacctctgtttcatgctaaccagacacgccgtgcactcgttagattcctttcttagaaaactcgttttctgctcccttccctcgtcccttccctccccgacaggtcacataacagctgcatcattgaccgcacagcgccatctctccctgagaataaagccgatagccaccc

SEQ ID NO: 114070 - DNA, 1442 bp, Homo sapiens
  Payload ID: 2290
  Gene Symbol: CAPG
  Gene Name: capping protein (actin filament), gelsolin-like
  Uniprot ID: P40121
  ENST ID: ENST00000263867
  CDS Start-End: 251-1297
gacggcctggcatacccactgcccaccccagtgactgctcttctgcttcaggcctgctggcctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaccacc

SEQ ID NO: 114071 - DNA, 1183 bp, Homo sapiens
  Payload ID: 2290
  Gene Symbol: CAPG
  Gene Name: capping protein (actin filament), gelsolin-like
  Uniprot ID: P40121
  ENST ID: ENST00000409670
  CDS Start-End: 72-1118
tccagggggcggggggcggctgagacagcgcccagggcctcggagcaaggcgttggcaggcaagtaacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggct

SEQ ID NO: 114072 - DNA, 835 bp, Homo sapiens
  Payload ID: 2290
  Gene Symbol: CAPG
  Gene Name: capping protein (actin filament), gelsolin-like
  ENST ID: ENST00000409275
  CDS Start-End: 180-835
cttacacgcgtcctggcgtgtggctctcctgcgtcctcgtttttctcgtgagccctggatctggacagtgggcccggcgcgaggccctcaactccggctgggctcccggtggcactttctgccgaccctgagatgtacccgccacgcctgcgggactgacctctagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctga

SEQ ID NO: 114073 - DNA, 1151 bp, Homo sapiens
  Payload ID: 2290
  Gene Symbol: CAPG
  Gene Name: capping protein (actin filament), gelsolin-like
  Uniprot ID: P40121
  ENST ID: ENST00000409724
  CDS Start-End: 105-1151
gactcaccgggggcggctcctggccgcgcacctccagggggcggggggcggctgagacagcgcccagggcctcggagcaaggcgttggcagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatga

SEQ ID NO: 114074 - DNA, 1195 bp, Homo sapiens
  Payload ID: 2290
  Gene Symbol: CAPG
  Gene Name: capping protein (actin filament), gelsolin-like
  Uniprot ID: P40121
  ENST ID: ENST00000409921
  CDS Start-End: 68-1069
aagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccca

SEQ ID NO: 114075 - DNA, 865 bp, Homo sapiens
  Payload ID: 2290
  Gene Symbol: CAPG
  Gene Name: capping protein (actin filament), gelsolin-like
  ENST ID: ENST00000439385
  CDS Start-End: 107-865
gctcccctcttcaactttagcactttctaatgctgacatctgtgattctgtgacattccccacttagaggaagttcgtctgcggtttcactggatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataag

SEQ ID NO: 114076 - DNA, 452 bp, Homo sapiens
  Payload ID: 2290
  Gene Symbol: CAPG
  Gene Name: capping protein (actin filament), gelsolin-like
  ENST ID: ENST00000453973
  CDS Start-End: 1-312
ctcacagctgacaaggcaaatgcccaggccgcagctctgtataagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 114077 - DNA, 930 bp, Homo sapiens
  Payload ID: 2290
  Gene Symbol: CAPG
  Gene Name: capping protein (actin filament), gelsolin-like
  ENST ID: ENST00000447219
  CDS Start-End: 172-930
agggggcggggggcggctgagacagcgcccagggcctcggagcaaggcgttggcaggagaggctttagcctagacagctgagtgtgaggaacagtgattcccattgatccttgttccctccgtgggtcacagagtccagaacttaagagccacccaagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataag

SEQ ID NO: 114078 - DNA, 839 bp, Homo sapiens
  Payload ID: 2290
  Gene Symbol: CAPG
  Gene Name: capping protein (actin filament), gelsolin-like
  ENST ID: ENST00000449030
  CDS Start-End: 81-839
gtggcacatttgattattttgcaaactctggaagaccttggctgagggtctaggtggactgtctgagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataag

SEQ ID NO: 114079 - DNA, 4334 bp, Homo sapiens
  Payload ID: 2291
  Gene Symbol: CAPRIN2
  Gene Name: caprin family member 2
  Uniprot ID: Q6IMN6
  ENST ID: ENST00000298892
  CDS Start-End: 752-3985
gtcggtgcctgcagggctctccgtggccgctcgggagaggtgctcttcgctcaggctcccccggagacttgagggggtgcgcgctggcgtgcatggggcctgttctgtccttggtttggggatgctcctaaggggggagaaagggatacctcgggtgcttggaggtcgagagacggatacgtaagtgcgcaagggccactgattagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccatgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgca

SEQ ID NO: 114080 - DNA, 4156 bp, Homo sapiens
  Payload ID: 2291
  Gene Symbol: CAPRIN2
  Gene Name: caprin family member 2
  Uniprot ID: Q6IMN6
  ENST ID: ENST00000395805
  CDS Start-End: 549-3266
tagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccatgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgc

SEQ ID NO: 114081 - DNA, 3535 bp, Homo sapiens
  Payload ID: 2291
  Gene Symbol: CAPRIN2
  Gene Name: caprin family member 2
  Uniprot ID: Q6IMN6
  ENST ID: ENST00000417045
  CDS Start-End: 549-3431
tagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccatgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagcc

SEQ ID NO: 114082 - DNA, 4398 bp, Homo sapiens
  Payload ID: 2291
  Gene Symbol: CAPRIN2
  Gene Name: caprin family member 2
  Uniprot ID: Q6IMN6
  ENST ID: ENST00000454014
  CDS Start-End: 752-1588
gtcggtgcctgcagggctctccgtggccgctcgggagaggtgctcttcgctcaggctcccccggagacttgagggggtgcgcgctggcgtgcatggggcctgttctgtccttggtttggggatgctcctaaggggggagaaagggatacctcgggtgcttggaggtcgagagacggatacgtaagtgcgcaagggccactgattagggcacgggaagggctcgctagaatgagctcttaaactggttgggtgtaagcggttttgggctagtctaaaccaaacaactgagaataaacgcggggttcctgcaggttgagagagtacctgtctgcaaatgtccagtagtgatggattgccttgtaggccccagagcaatcggggaagttagcattcttgttcaagaagctgctggttcacttagagctataaaagaatgttgtgagtttggattttcttccaaacgttcaggattgaggttagggctggtggtgagggatcatgtaaagaggtttgagtggctcagccttaggtcccggtgtggaaagcttattcttttggtgtcatcacgtggccatgggaattatttagaatgtgatctgccctcatgagaagaaaggagctctgaagccgttgcagttcttcctccctatgtggaaaatcgaatttctggaaacatcctccgtattgggagattttgcctatgtaaaggctatccttattggctagcggcactaattactttaaaagtaggatggaagtacaagtatctcaagcatcattgggtttcgagctcacttctgtggaaaagagtttaagggagtggtctagactttccagggaagttattgcctggctgtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgca

SEQ ID NO: 114083 - DNA, 3012 bp, Homo sapiens
  Payload ID: 2291
  Gene Symbol: CAPRIN2
  Gene Name: caprin family member 2
  ENST ID: ENST00000433722
  CDS Start-End: 1-2121
attaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaaggtgtttggaaacatctgagcctctttggttgctggggaaggccaggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgca

SEQ ID NO: 114084 - DNA, 2187 bp, Homo sapiens
  Payload ID: 2291
  Gene Symbol: CAPRIN2
  Gene Name: caprin family member 2
  ENST ID: ENST00000537108
  CDS Start-End: 82-2187
ctgggcgcgagcggctgagtcggctgggtctctggcgccgcagaggccgcgggcgaggaccgggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaaggtagtgagaaagcagtggtaggaacgacatacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaa

SEQ ID NO: 114085 - DNA, 628 bp, Homo sapiens
  Payload ID: 2291
  Gene Symbol: CAPRIN2
  Gene Name: caprin family member 2
  ENST ID: ENST00000543380
  CDS Start-End: 424-628
cactgacattttgtacaggataattcttcgttgtaaagggctgtcctgtgcattttaagatgtttggcagcatccctggcctctaaccacaagataccggtagcactcttcacctcccttccccctcccaagttgtgataaccaaaaatatccctagatattgccaggtatctttgggggacaaaattgttccctgttgagaagctactgtgttggggacacatgatttagtagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttg

SEQ ID NO: 114086 - DNA, 569 bp, Homo sapiens
  Payload ID: 2291
  Gene Symbol: CAPRIN2
  Gene Name: caprin family member 2
  ENST ID: ENST00000540584
  CDS Start-End: 212-569
agacgcgagtgcggggtggcgccggtccacctccgcagcgctcctgcctcccccaggctttggaaggcgggcccgggctgcggcagcggcggcctcggctgcctggggaggtgaagtcgggctgcggcggcctcggtcggcgcggcggagggaggcggctgacccggcgaggtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaa

SEQ ID NO: 114087 - DNA, 557 bp, Homo sapiens
  Payload ID: 2291
  Gene Symbol: CAPRIN2
  Gene Name: caprin family member 2
  ENST ID: ENST00000540436
  CDS Start-End: 178-557
gaggggagagggaggagacaggaggaggagacgcgagtgcggggtggcgccggtccacctccgcagcgctcctgcctcccccaggctttggaaggcgggcccgggctgcggcagcggcggcctcggctgcctggggagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttga

SEQ ID NO: 114088 - DNA, 6543 bp, Homo sapiens
  Payload ID: 2291
  Gene Symbol: CAPRIN2
  Gene Name: caprin family member 2
  ENST ID: ENST00000537553
  CDS Start-End: 1-523
gtgtccctctagtcctaattttatacttaactttcccccacctccttcagcctcatctgtttcaatggtgcaactcttttcatccccttttggttaccagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatgtgactactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggtaaaagaccaattgtcttaatttcttttgtatcttaaagaatagcagaaccagtttatcttatgaattacaggcatgattagttgaatgatgtaacatttatactttattaatgtattgctttctatagatattgtgatcttggaacttttacaggtaactttattgtagctttgccatataaatagatttaatatggtattgccttatctagtgcaataaatgtccatttttaatctaaaaaaatgaaaagtgtaggtagcattaagtcaagttttccactatatttacactgaaggacttttaggagaaaagtctcttatttgtataaatgaaagctcaataactttattttattaatattagcacttattgagttggaatgagttacaatcttgttttggctaactttgtcaaaaatattttcggtcagatgcagtggctcacacctgcaatcccagcactttgggaggccgaggcaggtggatcacttgaggtcaggagttcaagaccagcctggccaacatggtgaagccccatctctactaaaaatacaaaaattagctgggtgtggtggctcatgcctctagtcccaggtactcaggaggccgaggacagagaattgcttgaacccaggaggcgggggttgcagagattgtgccactgcacttcagcctgggtgacaaagtgatacttcatctcaaaaaaaataaataaataaaaacattttaacagtattatgtttgtgctttcaatttcaattctaagttacagtttttactaagtttgagtaaatccttgagatggacatagtaggatgaattttgaggagtaatttagcaactatcaggtattttttgttaactgttatagaagaatatgtattcattatagaatataagaaaatatagataatccttagtttttatggtgctggcttgatctgaatttaaattatctcattcctcattttaagaagaggaagaagtgattgttaccaagtaactcacagctgtctgcttcacaatctagttgagattggtttttggtattttttttaagcctttggatttataatctgttatgtcaagaacttgtggcttccttaggtaaggattacttaaattggatcggagttgttttctgttttaggtagctgacttagaaacctactaactaataagtctttaaaatagagaaaaattaacactaaacaactaatccaagttttttcttaaatccaattctgatgtataaattttgaataatattaggttcttaactggaaattaccatttcagggtttgaaaaggactaggtgcgtataaaaagttcagcccctcatctgttagactgattattggtaagactctttcacttagtcagcaagctgtgcaaagcaaatactggtatgcatcctcagcaattgagatttgaaattgtaagcaaaagctattcttttgcattcctgtgtccaaatgtcatcctaaagaacttgctgacttatgccagtttgggttttagagtaagttaactgcttgttatatggcaggtgattggctgatgctgcatttctcctccccaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactggtaagatctttgcatatgatatttggaagacttagagggacagccaattgaatggacagcaagtctaggaagtctgtagtgacactttagaagtattttcctgaccagtaagcattatttctttacatgttcctccagtgttgagaaaaacctaatgcccttttttgtgttaagtttacctattaattttaatttttgtagagatagaacttagatgacggatttaaccttgaagtaggtttgtatttttaaatctatttgctttgattaccacagacagtgattgaggtagatgggcactatctggctgcttatatgaaggttttgaaaccattctgttaatccttttaacaaatggttatctgtccttttctatcttataataaaagattgaagatatgacttagtatgctcattgtactgtttgcttagagatgggaggctattttgatttttcatgctgttctaaatcatgaaagaataggtaactttgtactcatttcttaatttaaatttaagaagcacttgtagattttttgtattggtatttcagatccctattgagttttttaactgaagtcggagcaaatgaattgagcattctgagtacttggctaatcaagtgatgaagaggtagtaatatgaattctgggacctaggcatagatgacctgattctgttctcccctctactgttgaaagacagggcaggtgacttacgtaagggatatttttgtcaggtgccttctcagatattaattagaatccattttcttttactccctcatctggagtatttagcctgctttttaaaaattgtcgtaaagtatacataacataaaaattaccattttaatcatttttaactatatagttctgtggcattaagtacaaccaaactgttgtgtaattattaccactgtccacctccagaacttttcatctccccccaactgaaactttgtaatcatttaatactaactcctcctcctcctctccccccagcccctggcaaccaccattctactttctgattctgaaaatgactgctctaggtacctcatataagtggtatacaatatttgtgcttttgaaactagcttattttacttggcatgtcttaagggttcattcatgttgtagcatgggtcaaaattttcttccttttttaggctgaataatattccattatatatatgaattacgtatttgagtcatgtagatgaattatatacatgaatatatgtatctcctatttatttttaaaggcagcaaattgtattaatgattttgatatatattggcttttaagtataaagactattaccatttaactcttggaccctaaaatcgtttttcttaagcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagctaactgcttcattatgagaaactcactgttgctaataaaacagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgcac

SEQ ID NO: 114089 - DNA, 770 bp, Homo sapiens
  Payload ID: 2291
  Gene Symbol: CAPRIN2
  Gene Name: caprin family member 2
  ENST ID: ENST00000542550
  CDS Start-End: 213-770
agtgcggggtggcgccggtccacctccgcagcgctcctgcctcccccaggctttggaaggcgggcccgggctgcggcagcggcggcctcggctgcctggggaggtgaagtcgggctgcggcggcctcggtcggcgcggcggagggaggcggctgacccggcgagggtgggcagtcaccttcaggccattcagaggaggaaagagaggggaatatgaagtcagccaagccccaagtgaaccacagtcagcatggggaaagccagcgggccttgagccccctgcagtctactctgagttctgctgcatctccttcccaagcgtatgagacctatattgaaaatggactcatatgccttaaacacaaaattagaaacatcgagaaaaagaagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaa

SEQ ID NO: 114090 - DNA, 630 bp, Homo sapiens
  Payload ID: 2291
  Gene Symbol: CAPRIN2
  Gene Name: caprin family member 2
  ENST ID: ENST00000541765
  CDS Start-End: 379-630
ggctgagtcggctgggtctctggcgccgcagaggccgcgggcgaggaccgggaggggagagggaggagacaggaggaggagacgcgagtgcggggtggcgccggtccacctccgcagcgctcctgcctcccccaggctttggaaggcgggcccgggctgcggcagcggcggcctcggctgcctggggagctcaaactggaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagtgttgaagaccagatggagcagtcatccttgtacttttgggaccttttggaa

SEQ ID NO: 114091 - DNA, 3221 bp, Homo sapiens
  Payload ID: 2291
  Gene Symbol: CAPRIN2
  Gene Name: caprin family member 2
  ENST ID: ENST00000548676
  CDS Start-End: 1-408
gaggattataaggatcgcctgaaaagtggagagcatcttaatccagaccagttggaagctgtagagaaatatgaagaagtgctacataatttggaatttgccaaggagcttcaaaaaaccttttctgggttgagcctagatctactaaaagcgcaaaagaaggcccagagaagggagcacatgctaaaacttgaggctgagaagaaaaagcttcgaactatacttcaagttcagtatgtattgcagaacttgacacaggagcacgtacaaaaagacttcaaagggggtttgaatggtgcagtgtatttgccttcaaaagaacttgactacctcattaagttttcaaaactgacctgccctgaaagaaatgaaagtctgagacaaacacttgaaggatctactgtctaaattgctgaactcaggctattttgaaagtatcccagttcccaaaaatgccaaggaaaaggaagtaccactggaggaagaaatgctaatacaatcagagaaaaaaacacaattatcgaagactgaatctgtcaaagagtcagagtctctaatggaatttgcccagccagagatacaaccacaagagtttcttaacagacgctatatgacagaagtagattattcaaacaaacaaggcgaagagcaaccttgggaagcagattatgctagaaaaccaaatctcccaaaacgttgggatatgcttactgaaccagatggtcaagagaagaaacaggagtcctttaagtcctgggaggcttctggtaagcaccaggaggtatccaagcctgcagtttccttagaacagaggaaacaagacacctcaaaactcaggtctactctgccggaagagcagaagaagcaggagatctccaaatccaagccatctcctagccagtggaagcaagatacacctaaatccaaagcagggtatgttcaagaggaacaaaagaaacaggagacaccaaagctgtggccagttcagctgcagaaagaacaagatccaaagaagcaaactccaaagtcttggacaccttccatgcagagcgaacagaacaccaccaagtcatggaccactcccatgtgtgaagaacaggattcaaaacagccagagactccaaaatcctgggaaaacaatgttgagagtcaaaaacactctttaacatcacagtcacagatttctccaaagtcctggggagtagctacagcaagcctcataccaaatgaccagctgctgcccaggaagttgaacacagaacccaaagatgtgcctaagcctgtgcatcagcctgtaggttcttcctctacccttccgaaggatccagtattgaggaaagaaaaactgcaggatctgatgactcagattcaaggaacttgtaactttatgcaagagtctgttcttgactttgacaaaccttcaagtgcaattccaacgtcacaaccgccttcagctactccaggtagccccgtagcatctaaagaacaaaatctgtccagtcaaagtgattttcttcaagagccgttacaggctacttcttctccagttacttgtagctcaaatgcttgcttggttactaccgatcaggcttcttctggatctgaaacagagtttatgacctcagagactcctgaggcagcaattcccccaggcaagcaaccgtcttcactagcttctccaaatcctcccatggcaaagggctctgaacagggcttccagtcacctccagcaagtagtagttcagtaaccattaacacagcaccctttcaagccatgcagacagtatttaacgttaatgcacctctgcctccacgaaaagaacaagaaataaaagaatccccttattcacctggctacaatcaaagttttaccacagcaagtacacaaacaccaccccagtgccaactgccatctatacatgtagaacaaactgtccattctcaagagactgcagcaaattatcatcctgatggaactattcaagtaagcaatggtagccttgccttttacccagcacagacgaatgtgtttcccagacctactcagccatttgtcaatagccggggatctgttagaggatgtactcgtggtgggagattaataaccaattcctatcggtcccctggtggttataaaggttttgatacttatagaggactcccttcaatttccaatggaaattatagccagctgcagttccaagctagagagtattctggagcaccttattcccaaagggataatttccagcagtgttataagcgaggagggacatctggtggtccacgagcaaattcgagagcagggtggagtgattcttctcaggtgagcagcccagaaagagacaacgaaacctttaacagtggtgactctggacaaggagactcccgtagcatgacccctgtggatgtgccagtgacaaatccagcagccaccatactgccagtacacgtctaccctctgcctcagcagatgcgagttgccttctcagcagccagaacctctaatctggcccctggaactttagaccaacctattgtgtttgatcttcttctgaacaacttaggagaaacttttgatcttcagcttggtagatttaattgcccagtgaatggcacttacgttttcatttttcacatgctaaagctggcagtgaatgtgccactgtatgtcaacctcatgaagaatgaagaggtcttggtatcagcctatgccaatgatggtgctccagaccatgaaactgctagcaatcatgcaattcttcagctcttccagggagaccagatatggttacgtctgcacaggggagcaatttatggaagtagctggaaatattctacgttttcaggctatcttctttatcaagattgaaagtcagtacagtattgacaataaaaggatggtgttctaattagtgggattgaaggaaaagtagtctttgccctcatgactgattggtttaggaaaatgtttttgttcctagagggaggaggtccttacttttttgttttccttcctgaggtgaaaaatcaagctgaatgacaattagcactaatctggcactttataaattgtgatgtagcctcgctagtcaagctgtgaatgtatattgtttgcacttaatccttaactgtattaacgttcagcttactaaactgactgcctcaagtccaggcaagttacaatgccttgttgtgcctcaataaaaaagttacatgca

SEQ ID NO: 114092 - DNA, 5821 bp, Homo sapiens
  Payload ID: 2292
  Gene Symbol: CPS1
  Gene Name: carbamoyl-phosphate synthase 1, mitochondrial
  Uniprot ID: P31327
  ENST ID: ENST00000233072
  CDS Start-End: 197-4699
ggggttaagagaaggaggagctgtggctgaagacatttaatggcagaatgaatggaaattcaaagatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgaaaaggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaagaggtaa

SEQ ID NO: 114093 - DNA, 699 bp, Homo sapiens
  Payload ID: 2292
  Gene Symbol: CPS1
  Gene Name: carbamoyl-phosphate synthase 1, mitochondrial
  ENST ID: ENST00000417946
  CDS Start-End: 335-699
gctcttttaaaatagttgctttcttaggaaatgtagttgctttcttaacctcatcaaattcatgaagatttagccgaggcccatgctacccattatcttctaaatggccttcagaaatgatggagaaactgacacgttatgagtatttcctgccctacatggattttgaacttgaattcccagcctcgcttgcatctagacacaggcacgtgacccaagccccaccagtcagacaaacccaattgaaactttagttcaaaagcatccagtatgagggagcagtgaagtttgcattttcctgatgaaaatgttggaagagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttgga

SEQ ID NO: 114094 - DNA, 5698 bp, Homo sapiens
  Payload ID: 2292
  Gene Symbol: CPS1
  Gene Name: carbamoyl-phosphate synthase 1, mitochondrial
  Uniprot ID: P31327
  ENST ID: ENST00000430249
  CDS Start-End: 56-4576
gaaatgtagttgctttcttaacctcatcaaattcatgaagatttagccgaggcccatgccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgaaaaggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaagaggtaa

SEQ ID NO: 114095 - DNA, 4770 bp, Homo sapiens
  Payload ID: 2292
  Gene Symbol: CPS1
  Gene Name: carbamoyl-phosphate synthase 1, mitochondrial
  Uniprot ID: P31327
  ENST ID: ENST00000451903
  CDS Start-End: 499-3648
gagaataaacagcagcaggagaaggaggggaagggtgttggaggggagagagggcatgcatgcacatacatagatgattcagacggcttcagaaaagaaccacaaggaatgcttagaggagttttgtatttaatctaaatatttttacttttttgtgtgtgagctcttagttcattgttcaaacccatctttccaaataaattcttctggtgatatccagaaaaatctgaagtctattgtgacttccccacacccaggggcctccagtagcaaatcttcattgtcagaactctcagaaaagacttcgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgaaaaggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaagaggtaa

SEQ ID NO: 114096 - DNA, 546 bp, Homo sapiens
  Payload ID: 2292
  Gene Symbol: CPS1
  Gene Name: carbamoyl-phosphate synthase 1, mitochondrial
  ENST ID: ENST00000523702
  CDS Start-End: 75-546
aaaatagttgctttcttaggaaatgtagttgctttcttaacctcatcaaattcatgaagatttagccgaggcccatgccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaat

SEQ ID NO: 114097 - DNA, 585 bp, Homo sapiens
  Payload ID: 2292
  Gene Symbol: CPS1
  Gene Name: carbamoyl-phosphate synthase 1, mitochondrial
  ENST ID: ENST00000518043
  CDS Start-End: 221-585
gctcttttaaaatagttgctttcttaggaaatgtagttgctttcttaacctcatcaaattcatgaagatttagccgaggcccatgctacccattatcttctaaatggccttcagaaatgatggagaaactgacacgttatgagtatttcctgccctacatggattttgaacttgaattcccagcctcgcttgcatctagacacagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttgga

SEQ ID NO: 114098 - DNA, 1542 bp, Homo sapiens
  Payload ID: 2292
  Gene Symbol: CPS1
  Gene Name: carbamoyl-phosphate synthase 1, mitochondrial
  ENST ID: ENST00000619804
  CDS Start-End: 1-1542
atgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtgccagacagctctga

SEQ ID NO: 114099 - DNA, 7265 bp, Homo sapiens
  Payload ID: 2293
  Gene Symbol: CAD
  Gene Name: carbamoyl-phosphate synthetase 2, aspartate transcarbamylase, and dihydroorotase
  Uniprot ID: P27708
  ENST ID: ENST00000264705
  CDS Start-End: 163-6840
gcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttgatgctgagtgtagtagaacagagctttcttttagaaaattgagcagattcccaaattataagagcagcctcaccaggcagggctctggctagggctgcgtgcccacactcggcattttcacactcgtgactctttgggactcggcaggagcgtgttaa

SEQ ID NO: 114100 - DNA, 6900 bp, Homo sapiens
  Payload ID: 2293
  Gene Symbol: CAD
  Gene Name: carbamoyl-phosphate synthetase 2, aspartate transcarbamylase, and dihydroorotase
  ENST ID: ENST00000403525
  CDS Start-End: 145-6633
cgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacgtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttg

SEQ ID NO: 114101 - DNA, 837 bp, Homo sapiens
  Payload ID: 2293
  Gene Symbol: CAD
  Gene Name: carbamoyl-phosphate synthetase 2, aspartate transcarbamylase, and dihydroorotase
  ENST ID: ENST00000456311
  CDS Start-End: 1-837
actcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgtgttcctccgcccaggagctgggatcccacggggcagcagagcgtgggctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacg

SEQ ID NO: 114102 - DNA, 953 bp, Homo sapiens
  Payload ID: 2293
  Gene Symbol: CAD
  Gene Name: carbamoyl-phosphate synthetase 2, aspartate transcarbamylase, and dihydroorotase
  ENST ID: ENST00000428460
  CDS Start-End: 1-881
tggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggtgagaccctcacagccctgcctggaagccatggagatgtgggttgggcagtcagagcccagcgctgcatccaccatggctctcctcaccctccaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacggggg

SEQ ID NO: 114103 - DNA, 806 bp, Homo sapiens
  Payload ID: 2293
  Gene Symbol: CAD
  Gene Name: carbamoyl-phosphate synthetase 2, aspartate transcarbamylase, and dihydroorotase
  ENST ID: ENST00000458503
  CDS Start-End: 1-806
gcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggagctgactgctttccacttgcaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacgg

SEQ ID NO: 114104 - DNA, 5709 bp, Homo sapiens
  Payload ID: 2294
  Gene Symbol: CHST11
  Gene Name: carbohydrate (chondroitin 4) sulfotransferase 11
  Uniprot ID: Q9NPF2
  ENST ID: ENST00000303694
  CDS Start-End: 440-1498
atatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatggtctcattatttctttttgtggcagcaaaattctaacatctttccagaagaaatctatgattcctgctttgcttgctacagctcatttgggggcatgaatgttctccttactaacctctcatggagtcatgtgataacagccattgtcatgtgtatggatgccaccattcttgaatttctgctagaaataagtaggttgctattgcacttagagtcatctttgcaagggactcattccaaaccaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccatatttgaaaacctcacattcggagcaggccactttatattcgtgagtgatcccaagctcactgaccaacagaaaagatgctaaaaaaatgtgtcctatcatgtgcctgctccaactgatgggtaatgtctgcctttaagccccagaatggattctccaggcacagtgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagactatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttttgccttttgttttgtttttgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttacgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttcacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaa

SEQ ID NO: 114105 - DNA, 756 bp, Homo sapiens
  Payload ID: 2294
  Gene Symbol: CHST11
  Gene Name: carbohydrate (chondroitin 4) sulfotransferase 11
  ENST ID: ENST00000546689
  CDS Start-End: 412-630
gcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaatcatgcggaggaatccctttggtgtggacatctgctgccggaaggggtcccgaagccccctgcaggaactctacaacccaatccaggtaagcttcaagcactctgtcagcatgtgaattttttttttttgtaggtatggatactaaaaactctaaaattgtggtctttgggggatttaaaacttcctttcacagcctggcattttaccttcagtggttgctttctccgtcaccctttttcta

SEQ ID NO: 114106 - DNA, 936 bp, Homo sapiens
  Payload ID: 2294
  Gene Symbol: CHST11
  Gene Name: carbohydrate (chondroitin 4) sulfotransferase 11
  ENST ID: ENST00000547956
  CDS Start-End: 445-678
ggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccaggtaagcttcaagcactctgtcagcatgtgaattttttttttttgtaggtatggatactaaaaactctaaaattgtggtctttgggggatttaaaacttcctttcacagcctggcattttaccttcagtggttgctttctccgtcaccctttttctatgtagcatctctgaaaaatctagcaggggatgtttagaattagagaaatgcctaggtttagtgctaagcattcagacctgcccagggtttgaactcctgagattaacagtctcaagttcgagcaatgggact

SEQ ID NO: 114107 - DNA, 573 bp, Homo sapiens
  Payload ID: 2294
  Gene Symbol: CHST11
  Gene Name: carbohydrate (chondroitin 4) sulfotransferase 11
  ENST ID: ENST00000549016
  CDS Start-End: 99-573
atagatacctgaacacccgtgttcatagcagcatgagtcacggtggccagaaggtggaagcaaccctaatgcccatcagtggatgaatgaatagtgtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaaca

SEQ ID NO: 114108 - DNA, 5696 bp, Homo sapiens
  Payload ID: 2294
  Gene Symbol: CHST11
  Gene Name: carbohydrate (chondroitin 4) sulfotransferase 11
  Uniprot ID: Q9NPF2
  ENST ID: ENST00000549260
  CDS Start-End: 442-1485
atatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaatcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatggtctcattatttctttttgtggcagcaaaattctaacatctttccagaagaaatctatgattcctgctttgcttgctacagctcatttgggggcatgaatgttctccttactaacctctcatggagtcatgtgataacagccattgtcatgtgtatggatgccaccattcttgaatttctgctagaaataagtaggttgctattgcacttagagtcatctttgcaagggactcattccaaaccaattccaatcgacctgaaagtcccttgcactaaagaaatgtgatttttttttaacccaaggagaaagttggttgtaacaatttttcaccagaattagcaatctgatagaataggcttttttaacaggaattttaaactggcggtgccagttgcagtgaaggtgaagtggctattgctttatattcgacaaatatttattgagcatctactatatactaggccctgaagatagagcgttgaacaaacccaatagtcttggccctcaaaaagctttatgtgacatagagcatccagctcgacaattagcaaacccctgatattattcatggacttgacatgaggtttggactattcatgagcaacagcagaaggtccatgacccctacaaatttacatttttctatggcccatatttgaaaacctcacattcggagcaggccactttatattcgtgagtgatcccaagctcactgaccaacagaaaagatgctaaaaaaatgtgtcctatcatgtgcctgctccaactgatgggtaatgtctgcctttaagccccagaatggattctccaggcacagtgtggaagagtgctgtggttgattagcaatgtctgccttgggtgaggaaaggggaacactcctcaagtgcctcctactgtcatctccattcagcctagcaccacatccccatgtagaagtgttgtcttctactgcttgccacgtacaagtgtgaaatgccaaggtgagactcgtacacttggggatttgcaatggtttttacccctcatgaaggtcagaggtggactatttgtacacatacacacatgcacaccctctcacgtcctccagaggctgaaagactatcagcatcttggtaactgccatgcatgagcagcaaggacagccttccataatccatgccccatttcctctggaagcctggaaacttttcatttcctgttccttgctaattaacatctaaacatgcttctcatttccagccattgctgatgcttctcagttgaagtttgagccacatccctcttacagctagtgaatgagttggtagcagctactgtatataataataataatagttttaataataggggagggtgggatggggtgtgggtaagttttgccttttgttttgtttttgatgccgtatatagtgaaggggtgaggatattctaaacaaacaaaaattgaataatttattcacagaaactattaagattgtattgtaaagctcacagcaagctcagtgggcagcagctgcaacatctcaccggggaaattattttatttaacgtgagtgagatgtgggccggagaaggtagctgaagctatttataaaacgttgtgtaccttcttccgagctctctcccctttgtgaagggcgcagcaactatacccttgatggatggagatttacgcaatgtgttttactgggtagagtgacagaccttggctgtccctggaattgagaatctggaccttatttccaggcagagaacactgtcctcagaaatgggacttctgataatgaaacaggttgtccaacattttctaatacgcattctacagaacacaggttccaggaggcatcaggttggtgtgatgcagactaagggttttgtggtcaaatatccttaagaaacaaagttaagtcagtttcctttctgcaaggacttttcagccttcaatgtgtgctgtgcatggtgaatccccaaaaataatccttgagtctgtagcatttcctgaacttacatgaccaggatactctattttgcagatcaccccacagagctagggttccaccgagtatactttgcttaggttgacttagcatatctgaggtcttcaaggataaaaactgccaccccaacacccttccattaaaaaaaaaatacaaaatagcaccacagtctccatctggtttatagcaacagaggtactttatttaatgaagcaatggttctaatcctggatactgccacggactacaattctatccctcccagagggagtggaggaagtcttgggtggtgtggacagaaggaagagaggagagggtgagtggggtatagggcccagggtggctccctactcctcaggctcaaaaggatgctcagtgggaacagatgatctcttgatgagtgcttcttcagtttcatagtttggaatcgttcactgtgtgctttttggggggttttcaatggaaattcacgttgctttgcatttctgtgtccgtctttggtcagttgtgcaagcctgctcactgtcatgtgaagatggcctttcatctggcttctctctcttaagtgagaaagattgtccttcaggggacatgacatcaataggtttctggaatgagggactctttctccccgtgttttgctttgtgttcacattttcttttctaatggcattgaaactttaaaaaaaatggattcaactgtttttgcagaatgtagaaagtattctgtgtccttggttaaagaaatccacttgtgaagtgtgcctggaaaatgaaagtttgtgttttttaaagaggaatatttgaaactgctttctatgcatgcttagctggagaaaagtacaggcaggcgtcccatctcccagccacttctcaaaggtgctgctgtgttttaaagaccaggtacagccagggcagtatttgcaaggacattcctgcttactttatccctttggttggaaagctctagatgattcccgcagctcctccagaccccgcctccctgccctccccagctggtctgggaagaggtggtctgctgacctgtggtatctcagaggggacgttcctcctcctccctgtgcaccaggtgggctgcaccctcctgcctattcaggatgtggatgccacaggagagcagcaggcagtggaaacttcagttgcactggttctcctggtggcaaaggcatgaagcacaggggtcgattaatccaggctactagaaagctccagagcaaagtgtgcgggtcccacaaatgcttggctggtggggtctggatcagtgctgagatagagttggcagaagaagcagaggcactctgcttgctttcctagccagtcctcccctacacacacacacacacacacacacacacacacacacaatctcagctgcgccattctgtgcaatcccagtgaccaaatcccttccttgcccacctctatgtcagcaggactgaccacatcactcccccgagttcccaccaccagcatttcctccaacctttttccatcacaaccagttagaaccctacaggcaacaaggccttctagaatccgcttaacccttggctgataacaggcaaatttcagtctgctacactttgttaggtccagaaggagctgcccatactactttcttatgagcatgctcagtatggcatatggacatgtaatgtcacatctttgtggagtgtgattttcttttttcacatatttgtatgcagtagagagcctgttgtagaaaacgctccctgtatcttgctgtactgttaaagaaagctgaattccacattgccaacaaaagcgtgaaaatgttcatgaaccttcctccaggaaaagccattcaagcctgattatttttctaagtaacttcaattaaattgaagaaaaaagaa

SEQ ID NO: 114109 - DNA, 15979 bp, Homo sapiens
  Payload ID: 2295
  Gene Symbol: CHST12
  Gene Name: carbohydrate (chondroitin 4) sulfotransferase 12
  Uniprot ID: Q9NRB3
  ENST ID: ENST00000258711
  CDS Start-End: 136-1380
gggctgcctctggggggtccgctagtcgcggggcggcggcggcggctgcgggcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctactaaaaaaaaaaaaaaaaaaaaaaaaaaaaaaaaaaaaatgagtcgggtgtggtggtgtgcacctgtagtcccagctactcaggagttctgagatggaaagattgcttgaacccaggaggcagaggctgcagtgagctgagatcgcgacattgcactctagcctgggtgacagagtgagattccatctcaaaataaataaataaatattaatacattatggctattaaggctgggcacggtggctcatgcctgcaatcctggcactttgggaggctgaggggggaagatcacttgagcccaggagttcaagaccagcttgggcaacatagcaaggacctcatctctacaaaaaataaaaaggacgtggtggtgcacatctgtaaacccagctactcaggaggctgaggagggaggatcacttgagcccaggagttcaagatcagtttggaccacatagcgagaccctgtgtctacaaaaaataagaaaatcagccggacatgatggtgcacacctgtaatcccagctactcgggaggctgaggcaggaggatcgctggagcccaggagttcaaggctgcagtgacctatgatcgtgccactgcactccagcctgggcagcaaagtgagactctgtttctaaatagacagatagaagataggtagatagatagattaaatagaaagtaaactatggctgttgaggtttacagttggcaggagtggagtggtttggcgtttatctctagaccgtgctggatgacagtacccagtgtcaccaagaagaggctccgtgtgactgtctctgtggctttctggttggtttagctccagtgccttcaccctcaaggacacgactgaccttgaaccctcaggtttgatgggccctgtcttgataaaagtgtcagaggaggctctggaaacatctggctgaaactcctttgctatttctgcttctaagctgtagttggagagatggttgcaatcatttcgtggtgtcgggcaccctgcttgacctgtcttcctcgtgtgtggtatttgtcaccactgcccagtccctggttgctggccacgctcagttgggacataccctggtgtcctctgtgtgtggtgtccctgtgtttcccaggctcaggtgggcttgtgtgggtcttggcccccagtgcctgctagcctcaggtgtcccctgtgttagacacctcctgccttcctttctgaagcttcgctttcttttatttttgttttgttttgtttttggagacagggtctcgctctgtcatccgggctggaatacactggtgcaatcacagctcactgcagcttcaacctcctgggctcaagtgatcttcccatctcagactcccaagtagctggggttacaggtgagcgccagcctgcccagctagttttttattttcagcagagatgaggtctcactgtgttgcccaggctgctctcaaactcctgggctcaagtgaccctcctgcatcaccctcccaaagtgctgggattacaggcatgagccatcacacctggcccctccaagttttttattatgataaaaatgtttaattttaaacgtaccatcttaaccattgttaagtgcactgttgtgtggcattaagcacattcgtattgtcgtgccaccaccaccatcatctccagagctttctcatcttcccaaactgaaactctgtccccattcagcactcgctccccattggtagaaggcagcagcttccactctctgatttctactacccgagctccctcagaaatggagtcacacagtattggtccttttgggactgaagtacttcacctcatgcaatgtcctctaggttcatcggtgtcgtggcaggtgtcagaactaacttcctttctgaggcggaataatgtcccattgtgtggaagaggcatggtttgtttatctgttcatcagttggtggacactgagttgcttctgccttcctgcgaatgtgaattgaatgctgctgtgaacagggtgtcagtgaatctgctgagggcttgttttccgtattctgggcatggccctttgtgtctgcctttgctggagcacctccccgggatgcgtttgtttataggatgttcagacgaatgtcagaacccactgggcggttcactcactgaggggggcccgcgtcccctccatttctgcattcccagttcttggtatggttcctctgaggttcggttttcctgagcacctggggtgtttgcagggatgtggaggggttcctgcagaagacaccacccacatccacgcacctgctcagattcccgggccatggtcggggccaccgcccgtggggatgactccggatgggagtggcagaaaagggcctgctgggccgaggggaggcgtctccgggaagagagggaggtgtgagcggggagaacccactttgattcttcgctgtttgcctgatgcgcagcaccacactgcgtagagacctttggctctggttttttctttttccactgaaacacagcaaattatacattttatgaaaattggcatcgtacaactggaaaatttaaccataaacttaaaactcttttaccctgttggcccccatcctccagctgtgtccacactttgagcacagtcatgagaatgacttggttgggtgcggggtggtgtcacaaagccctgtctcttgtgtgatggctgcgcctcgaatcagtgggagggcacctcgcccgtttacagttgggcaatgcttgggctgggcggcctggctgctcctggactcgcctcccagcgtctgatgctgtgtattttccatctgccccaggaatttgacacaggtgtgacttgcaggttgtgtgggtgatgcctccctccctctttcctcttaaagcatctcatgcttcttcattcgctgatacttacaacccccagtggatatttagtggagtttgctgtagtgcttttgccatttatttggactattggaaaaatttcaggtttggttttggccctatgtcttgatggagggcaagggttaggatttcagtttatcttcccggtgaggtctgagcacgtctgtgccctgaggtgggtggtttggtgaaggtggggctttaacctagctctgccacttaggaatcagaacacacacacacacgcgcgcacacacacacacacacacacactctctctcacacacacatcgggatatttttcttgtttccttcttccagagggtgtaggagttgtgttccaagtttgttcctgcaaaccctccgatgaggccagctgcattcatcggggcctggatggccgcacctctctctccccgccctgtctcctgcactcaggtgagaggctggcagggctgccgtaggggtggagagtgaacgcagggtggctaagccctcgtccctgtgagggacagtgacacggatgggagcagccatctgagctggaagctgtggacatggtccttgtgtgggtccaagcaaagtgggtggcgtgtgcattttgtgaacacgtggtctgcttcctggtgcagaccaggtctccccagagggaccctcctgagctgagctgcccggggcacctgtccctggatgtgaactgccttggttgtaccttggtggggggacctttcctgaatgtgttggttcggcatggtgacaggtgtttccctgcggcagaatgttggggccacaccaacgtccccagagtcttctccctagagtctctgaaaggaagcctgggttcctggtggtgctcccctccatgtgtgctcacccgcctgtatggaggcagcccaggggagcggctgagactcttggcagagagctggggacgctctgttctcattggcagccccaccctgaagaataacagactcccaaatatcacacaggctgcagataccacccagcccccaaggatgccatcaccaggctggggcgctcccatgcccattatccaggggtaatttttgctcacttatttataagccacacatcctcttctatcctaccaaacctaagaatatcaaaagggaaagcttggcttgcatggacgtaattaacctaaaagtctttaaacgtttctcccgagtgttggagtgactgtttgcacacatctgttgtgttttgcctgtgtgcattcctcctcctggtcagagagcccgtctcttccgccctctcccttaccctaggagggctgagtcaggcctccctacccaggcccaagggcagatgcacctgagccattgtgtcccatggttgatacgggacggggctgatttcctgacctggacccctgagacccagtgctcttagctgtgagcctctgggaagaggttctggcaggtggaggggatggacgttacagtgctgtggccacctagaaaagccgtcccggaactgagaccaactgctgagggaggaagggccaccagatcgggggccgggccggggtgagcacctgaagccggctccacctgctcttctcagctgtgcgcctccaggaatttgcactcgcttcagctgatttgggttggatttctagcgtttcacatacaggatctagactcgcacacaactgcattaatatgttggtgtttgataaactagggttgaaggagttccatcagtgaagagagaagccacgtgacctgaggatgcagggcactgttcacgtggacatgagccgtttcttagcatcatgagattttagaaacatgttcttactctgccaggacccagggataggtgaggctctcctattgggataccatttcaccagcagagagattaattggagaatgtgtaattttttcccctttggaaataatttgttcttttttttttttgacagagtttctttctgtcatccaggctggagtgcagtggtgtgatcatagctcactgcagcctcgacctcctgggctcaagtggtcctcccacctcagcctcccaagtagctgggactacaggcatgcaccaccatgcccggctaatttttacatttttggtagaggccgggtacggtggctcatgcctgtaatcccggcactttgggaggccgaggtgggtggatcacgaggtcaggagatcaagaccatcctggataacatggtgaaaccccgtctctactaaaatacaaaaaaattagccgggcgtggtggtgggcgcctgtagtcccagctactcgggaggctgaggcaggagaatggcgtgaacccgggaggcggagcttgcagtgagcggagattggcgccactacactccagcctgggcgacagagcgagactccgtctcaaaaaaaaatttttttttttggtagatacggggtcttgctttgtcacccaggctggtctcaaactcctgagctcgagtgctccttctgcctcagcctcccaaagtgctgggattacaggcgtgggctgctgtgcccagcaggaataatttctcagtgcatctctgatggggaggctaatgaagaaaggacacctggtttgaaggcttctctgtgtctgtccgtgggcgctactgatctgagccaagcaccattccgcaggcatgcctgaaatgactcccatggctgtcatggtgccatctggagagcatttgctcactgtaatggtcccgtcacacttgtctgatgaggatctgttggttgactttgacagtgataaacgaacacagcctatctgggtgttttttgcacttatagtttgggggtttgaagtactggctagaagctggcggggtgtgtgtgtgcaggtgtgcgagtgcatgtgcaagtgtgcgtgcaagtgtgagtctgcacttgtgtgcaagagaatgtgtgtgtgtgtgtgtttggagatttggacttgaaaattctagctcaggtctttggggtagtgtttgacctgaactctgaaaggcagagggtcccagactttcctgggatgatgggaactgggcaccccagatgaggctcggttgtgagtaggagcggggtgggccaccgaagagaagacagagtgggcctgtagggccagcccgaggtacccacagtggagggtctacaggctgatttgggaggtggtggtttatacctgtagtcaccttctatcttagttaggaattcaccttcacacttccagaaactgccaagaagaatgccgccgctcaggtttatctggtagaataagctgtttgaacaaagatctggaggttgcacaatcctgtgtcattctggatttatcttggggtcgggagtcaacgatacttcttgtgctgtcgtttctccggccgtgtgaagttaccacctcgtgagtggtcataagttagcgtgtctaaatgcactttgaaatcctaggatgaaaaagccaggccctgtcttttttccttgtctaagcaccatccttgcttaggagagacacggctgtggctctcaggctgtggggcaatgttctgcttataatgtttcaagaggttcaaagcgtgcaggccccatgctccgtgagagccttgacctgggtcagcaggggcggctgggcttgactcgagaattcccacagggcccgagggaagagcagagcaagagggaggagcgcgtggagccctatgtggcctgcgatattggggtggcgtccaggcccgcctagatgggggagggagacaacagagctgccacctgctcaccgcagacccaggggcccaggaggagcggactaggaccggcagtgccttccagcctaggtctcctgcccctgggctggagttcatcttttaggcaaatttggaataggaaccttaaaaatgctttcttcactcgtttaaatagtaatgataagaatatggctgcagggggcagcttatgcctgtaatcccaccattttgggagctcaaggcaggagtattgcttgagcccagaagtttgagaccagtctgggcaacatagtggaaacttgtctctccaaaagctaaaagaaaaagccgtgcatggtggtatgcacctgtagtcccagctacttgggaggctgaggtgggaggatcgcttgagtctgggaggtcgaggctgctgtgagccatgattgcaccactgcattccagcctgggtgacagagcaagatcttgtcttaaaaaaaaaaaaaaaaaaaaaggtgttgtattttatcattagaaggccatcctgtttagaagagtgggtttctcataagaaaaaaaagaaaaaggttgaccttgtaagtatattttcttgggtgaattgtggtggtggtaatggttttaactggtgttaatttcagttcttttaaaagttgtggtaagatacatgcaacataaaatgtgccctcttccccatttttaagtgaacagttcagtggcattaagcacattcagtttgcctgccaccgttaccaccatccatctccaaaattctctccatttacaaaactgaaactctgtccctattaaacactagctccccattccccactgtgccgcccccccaaagcccctggcaccaaccattctacttcctgtctctgagtttgactagggacctcctgtaagtggatttgtacaatatttgtccttttgtgtctggcttcttcatgtagtataatgtcttcaaggttcattcatgttgtagtcaggatcaccttccttttaaaggttgaacgatatcccgttgtatggacagaccacattttatccattcacccagggatggacacctgggttgcttccatctctcggctcttgtgaataatgctgctgtgaacacgggtgtgcagatacctgttcaagtccctgctgttttcttttgagacggagtctcgctctgtctcccaggctggagtgcggtggcaccatctcagctcactgcaagctccgcctcccaggttcaggccattctcctgcctcagcctcccgagtagctgggactacaggtgcccaccaccacgcctggctaattttttgtatttttagtagagacggagtttcaccatgttagccaggatgctctggatctcctgacctcgtgatccacccacctcggcctcccaaactgctgggattacaggcatgagacaccacgccccgccgagtccctgcttttaattctttggggcagggatccccaaccccctggtgatggaccaatactggcctgcggccccttaggaactggactgcacagcaggaggtgagcggcaggtgagcgtgcattcccgccggagccccgcctcccgtcagatcagcggcggcattagattctcataggagcgggaaccctcctgtgaaccctgcataccagggttctccatgcaacaatctaatgcctgatgatctgaagtggaacaggtttttgttttttttttccagacagagtcttgctctttcgcctaggctggagtgcagtggcatgatctcggctcactgcaacccctgcttcctgggttcaagtggttctcctgcctcagcctcccaagtagctgggattacaggtgcccgccaccatggccagctaatttttttgtttatttgtttatttattattttttgaggtggagtcttgctgtcacccaggctggagtgcagtggtgcaatctcagctcactgcaacctctgccttctgggttcaagccattcttgtgcctcagcttcccgagtaggtggaattataggcgtgtgccaccatgcccagctaatttttgtatttttagtagaggcgggatttcaccatgttggccaggctggtctcactcttgacctcaagtgatctgcccgcctcggcctcccaaagtgttgggattacaggtgtgagccaccgtgctcagcctgaagtgaaacagtttcatcccaaaagcatatacctctgccccatccatggaaaaattgcctctcatgaaaccagtccctggtgccaaaaaggttggggaccgcggctctggagtatatgcctaggagtaggagtgtggggtcatatggtaatttatctttaatttttggaggaattgaatttcaattcttattattaccaaaaatacttaaaattcttacagatggcatgggaaagtagcacacagtcgggactctgcagccgagtttgcctccttgaatgcacacataacacaggaacaaagacagagctgcttccctcctgttgggtctctggcggacagtcaggtatgctgagggagacactgttctcaaactccaggccagggtggtttccggagggtccaccggtggtctcatctcttctctctcaaaccatggatggtgccttttaaagaaaatgacaccggccaggtgcggtggctcatggctgtaatcccagcactttgggaggccgaggcgggtggatcacctgaggtcggaagttcaacaccagcctggccaacatggtgaaaccccgtctctattaaaaatacaaaaattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatacaaaaattagctgggtgtggtggtgggcacctgtaatcccagctactgaggaggctgaggcatgagattcgcttgagcctgggaggcagaggttgcagtgagctgagatcgcgccattgcactccagcctgggcaacagagtgagactctgtctcaaaaaacaaacaaaaatcaaagtgccaacctctgggctgtcccctcctggcctgccttgttcctgagctcaccagggtccttcactctgtggcactggcctcagccagcaccaaggctgaaagagcccattcagaggccagaaagaaactgttaggctctgaagccgtgggccaggccaagacagagattctgaggcatggttctggaatgggtttttccgcccacaggcactcaaggaggacagcattgggagatggctgggtggagagtctgcgggaggctacaaggcaaaaatcccctactccccctgggctccttcacagtttgtgtgtcctcacagagcaaggaagttctgtgagcctcattcaatcatctgaggttcttcccaggaaaattatagtgggaactctggctttgatgaaactgcttttttttcaaagcagtttgcaaaataaccggggccttaaaaaacaatctggatgaaatggtttttgccatttcaattggttctcttccaacgtgtcttccttccagtaggtttccagaatattttggtttcaaaatttgggggcacagatttgcaaagtggatttcaacatgtcgggtttcaaagggggctggctttgaaagtggtctgggcttctaaaaggtttgattgaaaactggtttggttctcagacattccagaagcttctcccggagtccagagcctcccagtggtgctttgggaagggggccaggcagggcgtcctggtgagtggacgtagggtgggcagggccacccttgtcctgggatgttgtggaggacttggcacgccctgtctcaggcctggctctggctctgggtggatgttttgcatcttcagaaaaaagctcctgtgggatatttctcctccagccgaccccgccccccagggcattcgagaaaagggtgcttgtctcttggtgagagggccacggttccttcagtttctccgttcctacgggcctctttctttttcctttttgagacggaatctcactgtgtcgcccaggctcactgcaacctatgcctcccgggttcaagtggttctcatgcttcagcctcctgagtagctgggattacaggtgtgtgccaccacatccagctaattttttgtatttttagtagagatggggttttcccatgttggccaggccggtctcgaactcctgacctcgtgatctgcccacgttggcctccaaagtgctaggattataagtgtgagccaccacaccaggcccgtttcatccctgcctcagcctgcatgccaagctccctgggtgcccgcccacaggtgtcaccctttaaggagaaagtggcctggggctggaaacaggactttgtagggaaggacagcgcgtgtgagaaaaggcctgttgatgggcacgccagggtttaatggacggctctttgaagtcatgggctgagccagaaggaattgtcatgatgtcagtctcatttccagatggggaaagggagacccaggctgcggtgacccactgaggcacaggatcagtgagaacccagccctggctttgcccagacctctcaagggcacttcgtgggaccattgccggccgttgtggcatctgtccctggccttgcccccatccgtctctgcacagcccaggtgggtccgagccagccccaggtctccagggtcccagcccagcctctagaagagccagcagcagggctggaagggagagcacatgctgggccttggggctgccttggacctcaggccgttgacaaggaaaagcggagagttgggaaaaaaggacaaatagctgagcgccagccgcagtctgggggacgggagcctcgtgcgactctcggagtgctggccagattggcagaggggaggagagaggaaaaacccaggctctgaggaaaaacctctccagcccagcgcgtggcctggcattaacccactgcagccccaggaagtggttccaccccaggcagccaacaaggcggtgcctgaactatgtctgtggatgacggagccacgacctgtccctcagggctcagcgctgcggctatgtccagggacccctggctgtgcccacgtcggggcttcccgttccttacctgccatgagaatgagatgtccagggacctccctgctccagctgggacctgtggggctttgtctgttgtcccgagcaccttggagatgtcatttctaacattttaacccaggaatccccccaccaagggacagagtgcaaggacatgatcgaacagaaaaagttctggtacaagatcaaccccgtggggtggtgagtgctgcagccccgggcctcacatcctgccgtccctgtgggagattggagcggtcccagtgcccaccgctgattctctggctccagcaacccctccaggtggatccgtcccacgcagcctggcctgaaacactgcccagccactgggtccagtaagacagagcctcgagtcattctgccaagaggatccagaaacacagactttttctggggtcctggaggcttctggcccatggggagcccctgggtcccagcgatccagccctgatgtgctgagggtgcagggcccagctgcagagcagaggagagtggcccccagggaccagcagcacgaaaggcacactgaggcacactggcaggcctgggctgcagagagcctgaaggtcatggggtagctggtggaagcaggaagaccccatacagcagcgaccactgaggctggtgctgcactttctcagggaattgagtgtgggctcccaccatcccggccactggcttcctccaaagcctcctcctcttacatcagcaaaccttctgttcggtgaccccctcagtgaccctctgtgcttgccttcgtggtcttcctcatggaggatttcgggtcagcgtgggggtcagaggtcatttcccataccccctcaaaggtacttcttgctgtggtccccacactctgacaccctcttctgaaatgaacacttttttgttgttgttgttgagacagagtcttgctctgtcgcccaggctggagtgcagtggcacaatcttagctcactgcaacctccacctcccaggttcaagcgattttcatgcctcagcttcccgagtagctgggattacaggcatgtgccaccaagcccagctaatttttgtatttttagtagagatgaggtttcaccatgttggccaggctggtctcgaacttctgacctcaagtgattcgcccgcctcggcctcccaaagtgctgggattacaagcatgagccactgcgcccggccacaaacacttttttttttttaaacaagtgaaaacaagtttattaacaaagttaagaaataaagaatggctattccatagggagagcagcctgaataaacactttttttgttgttgttgaggcagagcctcactctgtcgcccaggcaggagtgcagtggtgcgacctcagctctcagctccctgcaccgtccacctcctgggttcaagcgcttcttccccaagtagctgggactataggcacacaccaccatgcccggctaatttttctctttttagtagagacaggatttcgccatgtgggtcgggctggtctcgaactcctggtctcaagtgatccgccctcctcggccttccaaaatgctaggattacaggcatgagccgccgtgcctggccacaaacatattttaaatttgaacaataaaggaactggaccaggaagtgtggagttggggagaccctgctctcgccaggtgccttcccggcaggttgtctctgcctccccttgcaccccttgaatggcgggctccctctcccatagcccctgccaggctggataaccaacttcattcttatacccgtccgaatctgccccctgttaatggcacccaccagtccttgtccaaacctcgaagctcaggacctcacagagcaccacgtcctcttctgtgtcatatgcagctggatctcagtaaatggcaatgtcttctct

SEQ ID NO: 114110 - DNA, 921 bp, Homo sapiens
  Payload ID: 2295
  Gene Symbol: CHST12
  Gene Name: carbohydrate (chondroitin 4) sulfotransferase 12
  ENST ID: ENST00000432336
  CDS Start-End: 186-921
ggatccccagctcccgagggcccccgtgtgcctgctgtcacctgaacggggctccccggccccgccgaccgcagccctggagcctgcagacgccagcagcaccggcaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcg

SEQ ID NO: 114111 - DNA, 2131 bp, Homo sapiens
  Payload ID: 2295
  Gene Symbol: CHST12
  Gene Name: carbohydrate (chondroitin 4) sulfotransferase 12
  Uniprot ID: Q9NRB3
  ENST ID: ENST00000618655
  CDS Start-End: 192-1436
gctcctgcgccgggggcggggccggcgagggctgcctctggggggtccgctagtcgcggggcggcggcggcggctgcgggcgcgaggtgaggggcgcgaggtgagggtcgcgaggttcccagcaggatgccccggctctgcaggaagctgaagtgagaggcccggagagggcccagcccgcccggggcaggatgaccaaggcccggctgttccggctgtggctggtgctggggtcggtgttcatgatcctgctgatcatcgtgtactgggacagcgcaggcgccgcgcacttctacttgcacacgtccttctctaggccgcacacggggccgccgctgcccacgcccgggccggacagggacagggagctcacggccgactccgatgtcgacgagtttctggacaagtttctcagtgctggcgtgaagcagagcgaccttcccagaaaggagacggagcagccgcctgcgccggggagcatggaggagagcgtgagaggctacgactggtccccgcgcgacgcccggcgcagcccagaccagggccggcagcaggcggagcggaggagcgtgctgcggggcttctgcgccaactccagcctggccttccccaccaaggagcgcgcattcgacgacatccccaactcggagctgagccacctgatcgtggacgaccggcacggggccatctactgctacgtgcccaaggtggcctgcaccaactggaagcgcgtgatgatcgtgctgagcggaagcctgctgcaccgcggtgcgccctaccgcgacccgctgcgcatcccgcgcgagcacgtgcacaacgccagcgcgcacctgaccttcaacaagttctggcgccgctacgggaagctctcccgccacctcatgaaggtcaagctcaagaagtacaccaagttcctcttcgtgcgcgaccccttcgtgcgcctgatctccgccttccgcagcaagttcgagctggagaacgaggagttctaccgcaagttcgccgtgcccatgctgcggctgtacgccaaccacaccagcctgcccgcctcggcgcgcgaggccttccgcgctggcctcaaggtgtccttcgccaacttcatccagtacctgctggacccgcacacggagaagctggcgcccttcaacgagcactggcggcaggtgtaccgcctctgccacccgtgccagatcgactacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcctgtggtttttctgagcgtgcgggcgccgggaggggatgctgaggctgatggagctgcctccagggctagggccactcaccggaggagggcggggcctgcacttgaagtcaggccgcacctgtctgtttttggaagggtagccgacaaatccttccagagggaaagttctttgtttaagtgttgtacttgaaaaggtcaatcttcagggcttcctgtttgaagtcaagtcagaggtaaaccggtcagttacagaagcaggatttctaggatttctaactccagctgttcccatactgtctagtttaaattatggctgttaaggccgggcgggtgactcaggcaggtaatcccagaactttgggaggcccagacagaaggatcgcttgaggtcaggaatttgagacctggccaacatggtgaaaccctgtctctact

SEQ ID NO: 114112 - DNA, 1789 bp, Homo sapiens
  Payload ID: 2296
  Gene Symbol: CHST13
  Gene Name: carbohydrate (chondroitin 4) sulfotransferase 13
  Uniprot ID: Q8NET6
  ENST ID: ENST00000319340
  CDS Start-End: 51-1076
gcccccagccgtatccagcggactgtcctccgccgcgcgcccggcacagcatggggaggcgctgctgccggcggcgcgtgctggcggccgcctgtctgggcgccgcgctcctgctcctatgcgccgcgccccgctccctgcgcccggcatttggaaacagagccctgggctccagctggcttggtggggagaagagaagccccctgcagaagctctatgacctggatcaggacccgcgctcgaccctggcgaaggtgcaccggcagcggcgcgacctgctgaacagcgcctgtagccgccactcacgccggcagcgcctgctacagccggaggacctgcggcacgtgctggtggacgacgcgcatggcctgctctactgctacgtgcccaaggtggcctgcaccaactggaagcgcgtgctgctggcgctgagcggccaagcccgcggcgacccgcgcgccatctccgcgcaagaggcgcacgcgcctggccgcctgccctcactggccgacttcagccccgccgagatcaaccggcgcctgcgcgcctacttggccttcctgttcgtgcgggagcccttcgagcgcctggcatcggcttaccgcaacaagctcgcgcgcccctacagcgccgccttccagaggcgctacggtgcacgcatcgttcagcgcctgcggccgcgcgcgctccccgacgcccgggcccgcggccacgacgtgcgcttcgcggagttcctggcctacctgctggacccgcgcacgcggcgtgaggagcccttcaacgagcactgggagcgcgcgcacgcgctctgccacccgtgtcgcctccgctacgacgtcgtgggcaagttcgagacgctggcggaggacgcggccttcgtgctgggcctggcgggcgcatccgacctgagcttccctgggccgccgcggccccggggagccgccgcctcccgcgacctggcagcgcgcctcttccgggacatcagccccttctaccagcggcgcctcttcgacctctacaagatggacttcctgcttttcaactactccgccccctcctacctgcggctgctctagcggtcctggaggtcctgtggccacgcggggcaagtgcctttccgacaagacccccggggaatgcaggtgctgccggccccaggacccctcttcaagagccactgcgtgcactcacctggccgccgggccagcgggcgcagggcacacctggccaggcttgggggcagcccatctcaggtggccctgcacgcgtgtgcctgcctcggcctgtcgcctgaggcctgcttcctccacttgctccagctgacaggcacctctccaggccccgtagatgggcaaggacttgataaccagggttttaggcttttaaaggccattttgggggtcagccctgcccctgaacctgttcatggtgcatcagaacataatgctgacaccggtgtcagtgtggcccgagcctgtgtcctccccacctcgcccaccctggcaaggacagctgcggccaaggacgaaagccctcccttggctggcctcacgatggggccgtcccgggagccaggtgggagctgccttccactgccatcgggtctcctctcctctcccacgcggctggccctacccaggcgccaccttcggtctcagtctggcaagacgctgggtcttcaggctccatgccaacagagcccctggtgcaatgcggtcacaggttttatgggactttggtgagctgggcggtcatggttttgaaataaatgtattttgttactttctga

SEQ ID NO: 114113 - DNA, 1146 bp, Homo sapiens
  Payload ID: 2296
  Gene Symbol: CHST13
  Gene Name: carbohydrate (chondroitin 4) sulfotransferase 13
  ENST ID: ENST00000615522
  CDS Start-End: 1-678
atggggaggcgctgctgccggcggcgcgtgctggcggccgcctgtctgggcgccgcgctcctgctcctatgcgccgcgccccgctccctgcgcccggcatttggaaacagagccctgggctccagctggcttggtggggagaagagaagccccctgcagaagctctatgacctggatcaggacccgcgctcgaccctggcgaaggtgcaccggcagcggcgcgacctgctgaacagcgcctgtagccgccactcacgccggcagcgcctgctacagccggaggacctgcggcacgtgctggtggacgacgcgcatggcctgctctactgctacgtgcccaaggtggcctgcaccaactggaagcgcgtgctgctggcgctgagcggccaagcccgcggcgacccgcgcgccatctccgcgcaagaggcgcacgcgcctggccgcctgccctcactggccgacttcagccccgccgagatcaaccggcgcctgcgcgcctacttggccttcctgttcgtgcgggagcccttcgagcgcctggcatcggcttaccgcaacaagctcgcgcgcccgcgctctgccacccgtgtcgcctccgctacgacgtcgtgggcaagttcgagacgctggcggaggacgcggccttcgtgctgggcctggcgggcgcatccgacctgagcttccctgggccgccgcggccccggggagccgccgcctcccgcgacctggcagcgcgcctcttccgggacatcagccccttctaccagcggcgcctcttcgacctctacaagatggacttcctgcttttcaactactccgccccctcctacctgcggctgctctagcggtcctggaggtcctgtggccacgcggggcaagtgcctttccgacaagacccccggggaatgcaggtgctgccggccccaggacccctcttcaagagccactgcgtgcactcacctggccgccgggccagcgggcgcagggcacacctggccaggcttgggggcagcccatctcaggtggccctgcacgcgtgtgcctgcctcggcctgtcgcctgaggcctgcttcctccacttgctccagctgacaggcacctctccaggccccgtagatgggcaaggacttgataaccagggtttta

SEQ ID NO: 114114 - DNA, 6970 bp, Homo sapiens
  Payload ID: 2297
  Gene Symbol: CHST3
  Gene Name: carbohydrate (chondroitin 6) sulfotransferase 3
  Uniprot ID: Q7LGC8
  ENST ID: ENST00000373115
  CDS Start-End: 438-1877
gccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagccagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctggaattcctccttagggccctgggaagagtattgcttaacgcaggatgtgctgggtgttttgtttcgggcttttatttatggcttggtgtctttcttgtttcatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcagttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacttgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgca

SEQ ID NO: 114115 - DNA, 2718 bp, Homo sapiens
  Payload ID: 2298
  Gene Symbol: CHST1
  Gene Name: carbohydrate (keratan sulfate Gal-6) sulfotransferase 1
  Uniprot ID: O43916
  ENST ID: ENST00000308064
  CDS Start-End: 672-1907
gctcggagctgtagccgccgctgccgccgctgctcttggctcggggacgcgggcgggcgctccgagaggctctggtgcctgcggctgctgctctcctccggcgcccggggctgcggcgctccgggtcccggcccctgtcccggcatctctcgggtccctgagccccggccccgggtcccgcgtccggccggagagaacgcactcagctgctcgagccgccccgggctcgcgcccccgggccatgaagaggggcccgtgaggcgcgcgcggagtcggaggaagaggagggaggagggaggccgaggaggagggcgcgggaggcggaggatgccgccgcggctgctgccgccgccgccacccgcgggtccccggcgaccctgactccagacccgaggatggagccggcgctgggcgctgcagctgctcccggcgcgtccccgaccaggtagctggtgtcacttcggtgtggttggaagaagactttctccccagctgcattcccggaggcgccctttcgacctggaggccgggtctgctggccacagggctgccgcactggctgggactgccagctgggcctggagacgctggtggctgtggactccccagcttggagcagtccctctttgacctcaccccttggagaagcagccccatgaaggtgcccagccatgcaatgttcctggaaggccgtcctcctccttgccctggcctccattgccatccagtacacggccatccgcaccttcaccgccaagtcctttcacacctgccccgggctggcagaggccgggctggccgagcgactgtgcgaggagagccccaccttcgcctacaacctctcccgcaagacccacatcctcatcctggccaccacgcgcagtggctcctccttcgtgggccagctcttcaaccagcacctggacgtcttctacctgtttgagcccctctaccacgtccagaacacgctcatcccccgcttcacccagggcaagagcccggccgaccggcgggtcatgctaggcgccagccgcgacctcctgcggagcctctacgactgcgacctctacttcctggagaactacatcaagccgccgccggtcaaccacaccaccgacaggatcttccgccgcggggccagccgggtcctctgctcccggcctgtgtgcgaccctccggggccagccgacctggtcctggaggagggggactgtgtgcgcaagtgcgggctactcaacctgaccgtggcggccgaggcgtgccgcgagcgcagccacgtggccatcaagacggtgcgcgtgcccgaggtgaacgacctgcgcgccctggtggaagacccgcgattaaacctcaaggtcatccagctggtccgagacccccgcggcattctggcttcgcgcagcgagaccttccgcgacacgtaccggctctggcggctctggtacggcaccgggaggaaaccctacaacctggacgtgacgcagctgaccacggtgtgcgaggacttctccaactccgtgtccaccggcctcatgcggcccccgtggctcaagggcaagtacatgttggtgcgctacgaggacctggctcggaaccctatgaagaagaccgaggagatctacgggttcctgggcatcccgctggacagccacgtggcccgctggatccagaacaacacgcggggcgaccccaccctgggcaagcacaaatacggcaccgtgcgaaactcggcggccacggccgagaagtggcgcttccgcctctcctacgacatcgtggcctttgcccagaacgcctgccagcaggtgctggcccagctgggctacaagatcgccgcctcggaggaggagctgaagaacccctcggtcagcctggtggaggagcgggacttccgccccttctcgtgacccgggcggtgcgggtgggggcgggaggcgcaaggtgtcggttttgataaaatggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccccccccattcagacacatggatgttgggtctctgtgcggacggtgacaatgtttacaagcaccacatttacacatccacacacgcacacgggcactcgcgaggcgacttctcaagcttttgaatgggtgagtggtcgggtatctagtttttgcactgtcttactattcaaggtaagaggatacaaacaagaggaccacttgtctctaatttatgaatggtgtccatcctttccccatccctgcctcctgcccctgacgcccatttccccccttagagcagcgaaactgccccctcctgcccgcccttgcctgtcggtgaggcaggtttttactgtgaggtgaacgtggacctgtttctgtttccagtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataatc

SEQ ID NO: 114116 - DNA, 3574 bp, Homo sapiens
  Payload ID: 2299
  Gene Symbol: CHST14
  Gene Name: carbohydrate (N-acetylgalactosamine 4-0) sulfotransferase 14
  Uniprot ID: Q8NCH0
  ENST ID: ENST00000306243
  CDS Start-End: 217-1347
tccggcccgggtccctcgccgcgcccgccgcccgccgcccgcttcggcgccgcagcccgggagccggccacccctacacgcgccagggctgtcccctgccctcccctccccaactacccccggtcccagaccctcctcccgcccccagcccgagcccgccttccaggccgccctcggatcggccgggcccgcgcaggcccccaccccttgagcaccatgttcccccgcccgctgaccccgctggcggccccaaatggcgccgagcccctgggccgggcgctgaggcgggcccctctgggcagggcccgggcggggctgggtgggccgcccctgctgctgccgtccatgctgatgtttgcggtgatcgtggcctccagcgggctgctgctcatgatcgagcggggcatcctggccgagatgaagcccctgcccctgcacccgcccggccgcgagggcacagcctggcgcgggaaagcccccaagcctgggggcctgtccctcagggctggggacgcggacttgcaagtgcggcaggacgtccggaacaggaccctgcgggcggtgtgcggacagccaggcatgccccgggacccctgggacttgccggtggggcagcggcgcaccctgctgcgccacatcctcgtaagtgaccgttaccgcttcctctactgctacgtccccaaggtggcctgctctaactggaagcgggtgatgaaggtgctggcaggcgtcctggacagcgtggacgtccgcctcaagatggaccaccgcagtgacctggtgttcctggccgacctgcggcctgaggagattcgctaccgcctgcagcactactttaagttcctgtttgtgcgggagcccttggaacgcctcctctctgcctaccgcaacaagtttggcgagatccgagagtaccagcaacgctatggggctgagatagtgaggcggtacagggctggagcggggcccagccctgcaggcgacgatgtcacattccccgagttcctgagatacctggtggatgaggaccctgagcgcatgaatgagcattggatgcccgtgtaccacctgtgccagccttgtgccgtgcactatgactttgtgggctcctatgagaggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggacttctccctctttgcctacccactgcctaatgtcaccaaggaggcgtgtcagcagtgaccatgggtgtggggccagcagctggtggggactggtttcaacgccagctttctgtgcttctgcctgtcattcggagaaactctggctctggggcttggggcttctcaggatcctggatggcagagactgccctcagaagttccttgtccagggtgggcacccacagtgactcagaggacagggctaggcaggagacctgctgctcctcattggggggatctcttggggggcagacaccagtttgccaatgaagcaacacatctgatctaaagactggctccagaccccgggctgccaggattatgcagtccacttggtctaccttaatttaacctgtggccaaactcagagatggtaccagccaggggcaagcatgaccagagccagggaccctgtggctctgatcccccatttatccaccccatgtgcctcaggactagagtgagcaatcataccttataaatgacttttgtgcctttctgctccagtctcaaaatttcctacacctgccagttctttacatttttccaaggaaaggaaaacggaagcagggttcttgcctggtagctccaggacccagctctgcaggcacccaaagaccctctgtgcccagcctcttccttgagttctcggaacctcctccctaattctcccttccttccccacaaggcctttgaggttgtgactgtggctggtatatctggctgccatttttctgatgcatttatttaaaatttgtactttttgatagaacccttgtaagggctttgttttcctaatagctgactttttaataaagcagttttatatataaggcgagcatttctgtgatttcccttggagctcctgtgggcccagcagatctcctcgatgtctgtcttcccatgtcaggggaggcagcctgtagatagagaaagtaaggtataacttggttgggctggtccaatgggccgttgccattccatggagactttgggggctttctaataggctataccagatcacagactcagatcctgggatgtcaccaaagggcaagcccagttaggaatggcctcacgtccagagcatacctacatgtattattccctaaaaaagtaggtgggtaggagatacgggatcctcctcttattcaataagagttgaatgagaagttcccccagagcattttctttctttcttttttttttttttttttttgagatgaagtctcgatctgtcacccaggctgcagtgcagtagcaccatcttggctcactgcaacctctacctcctgggttctagcgattgcctcagcctcccaagtagctgggatgattacaggcacgcaccaccacacctggctaatttttgtatttttagtagagatggggtttcaccatgttggccaggctggttttgaactcctaacctcaggtgatctgcccacctcggcccctccaaagtgctaggattacaggcgtgagctaccacgcctggccccggaccattttcaaatgaaaaagaaaatttttgtgtgagcaaggagatttttttctggcactacaaggaaggcaggcaaggaggttgagtgagggtcaggctcttgttgacttaggtccagagaaagttgtggaaggaatacagttggagcagcagaggacagacttcagtatggcccattgcccccactgctctccagggatcccaggcccatcaggagttgctgggcccaagggagagttgcaaggccagagctggcccttctctgttagccctatttcacacacccccagtgggaactgctgtactttatagagacctgaggctatggtaagaggggggcccaaggaagggaggcagggagggcccccttgcaggtgctacctgtcgctagctttgctattgattggactttgtagaggaaaactaacactatttcccatatttgggatagggggcttctatgggcacttatggctctccactatgactcatcaggccatgttgcttccagaaggccttacctgaccccctgtctggctcagatgtccttcttcagagtccccttggctctggggactttacctagaccgatcaagtcccagccctattcctcaccagatgcctatctctcagagcctctgttttctccaatgtgtcgtgggaataaaaacacctatctcatgtagattgctaggagaggggaggattaatgaagacaaaatgaataaaagggcccatcccc

SEQ ID NO: 114117 - DNA, 1968 bp, Homo sapiens
  Payload ID: 2299
  Gene Symbol: CHST14
  Gene Name: carbohydrate (N-acetylgalactosamine 4-0) sulfotransferase 14
  ENST ID: ENST00000559991
  CDS Start-End: 129-1184
ctgtcccctgccctcccctccccaactacccccggtcccagaccctcctcccgcccccagcccgagcccgccttccaggccgccctcggatcggccgggcccgcgcaggcccccaccccttgagcaccatgttcccccgcccgctgaccccgctggcggccccaaatggcgccgagcccctgggccgggcgctgaggcgggcccctctgggcagggcccgggcggggctgggtgggccgcccctgctgctgccgtccatgctgatgtttgcggtgatcgtggcctccagcgggctgctgctcatgatcgagcggggcatcctggccgagatgaagcccctgcccctgcacccgcccggccgcgagggcacagcctggcgcgggaaagcccccaagcctgggggcctgtccctcagggctggggacgcggacttgcaagtgcggcaggacgtccggaacaggaccctgcgggcggtgtgcggacagccaggcatgccccgggacccctgggacttgccggtggggcagcggcgcaccctgctgcgccacatcctcgtgctggcaggcgtcctggacagcgtggacgtccgcctcaagatggaccaccgcagtgacctggtgttcctggccgacctgcggcctgaggagattcgctaccgcctgcagcactactttaagttcctgtttgtgcgggagcccttggaacgcctcctctctgcctaccgcaacaagtttggcgagatccgagagtaccagcaacgctatggggctgagatagtgaggcggtacagggctggagcggggcccagccctgcaggcgacgatgtcacattccccgagttcctgagatacctggtggatgaggaccctgagcgcatgaatgagcattggatgcccgtgtaccacctgtgccagccttgtgccgtgcactatgactttgtgggctcctatgagaggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggacttctccctctttgcctacccactgcctaatgtcaccaaggaggcgtgtcagcagtgaccatgggtgtggggccagcagctggtggggactggtttcaacgccagctttctgtgcttctgcctgtcattcggagaaactctggctctggggcttggggcttctcaggatcctggatggcagagactgccctcagaagttccttgtccagggtgggcacccacagtgactcagaggacagggctaggcaggagacctgctgctcctcattggggggatctcttggggggcagacaccagtttgccaatgaagcaacacatctgatctaaagactggctccagaccccgggctgccaggattatgcagtccacttggtctaccttaatttaacctgtggccaaactcagagatggtaccagccaggggcaagcatgaccagagccagggaccctgtggctctgatcccccatttatccaccccatgtgcctcaggactagagtgagcaatcataccttataaatgacttttgtgcctttctgctccagtctcaaaatttcctacacctgccagttctttacatttttccaaggaaaggaaaacggaagcagggttcttgcctggtagctccaggacccagctctgcaggcacccaaagaccctctgtgcccagcctcttccttgagttctcggaacctcctccctaattctcccttccttccccacaaggcctttgaggttgtgactgtggctggtatatctggctgccatttttctgatgcatttatttaaaatttgtactttttgatagaacccttgtaagggctttgttttcctaatagct

SEQ ID NO: 114118 - DNA, 2479 bp, Homo sapiens
  Payload ID: 2300
  Gene Symbol: CHST8
  Gene Name: carbohydrate (N-acetylgalactosamine 4-0) sulfotransferase 8
  Uniprot ID: Q9H2A9
  ENST ID: ENST00000262622
  CDS Start-End: 759-2033
gggactcgtcccagagtttgctgccgccgccgccgctgccattagagcggttttaattagctgcaggatttttaatgagctgaaatcaagaagagccccatctcagaagtaagcgagagccgcgcgcagggaagaactagtctgacaaaacagaaggaggtggtgctctcgggggactgggctgtaggctcccaccgatcgatcggcgacgagcagatgagttcccgaggccaggaggctgaggagggaagccagggctcagagaccagcgcccggtgcagagtccccgctgctgccaccgcggcagaaggcacggtgccggattcaaggtgacggcagtgcctggctccattctcctcaagttgccatagcagcctctctcccaacaagcagcttctccgggagccctcagccgggagggacgtcattgttctctcctgcccgtgtggtgcaaggagacccaccggacagagaactttcccgagcccggggtccgctgaccacgtgggtgcacccatgctgcctggagccaggcacagggacaggtccccacggccacagggaatcctctgggcagctgaggggagcgtccaggcccagaagcagctgcagccaagcgtgtccttggagccgtccatgcgtctgtccgcctgctgccggtcgccactggagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagca

SEQ ID NO: 114119 - DNA, 2225 bp, Homo sapiens
  Payload ID: 2300
  Gene Symbol: CHST8
  Gene Name: carbohydrate (N-acetylgalactosamine 4-0) sulfotransferase 8
  Uniprot ID: Q9H2A9
  ENST ID: ENST00000434302
  CDS Start-End: 506-1780
ttcgctgggagccttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccaggtttaaaggtcaacaagaatatcttaccttaatttgacaagtacgcaagaaataatgcaagactcgtttatgttcagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagc

SEQ ID NO: 114120 - DNA, 2133 bp, Homo sapiens
  Payload ID: 2300
  Gene Symbol: CHST8
  Gene Name: carbohydrate (N-acetylgalactosamine 4-0) sulfotransferase 8
  Uniprot ID: Q9H2A9
  ENST ID: ENST00000438847
  CDS Start-End: 413-1687
ccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctctactgcgaggtgcccaaggccggctgctccaattggaagcgggtgctcatggtgctggccggcctggcctcgtccactgccgacatccagcacaacaccgtccactatggcagcgctctcaagcgcctggacaccttcgaccgccagggtatcttgcaccgtctcagcacctacaccaagatgctctttgtccgcgagcccttcgagaggctggtgtccgccttccgcgacaagtttgagcaccccaacagctactatcacccggtcttcggcaaggccatcctggcccggtaccgcgccaatgcctctcgggaggccctgcggaccggctctggggtgcgttttcccgagttcgtccagtacctgctggacgtgcaccggcccgtggggatggacattcactgggaccatgtcagccggctctgcagcccctgcctcatcgactacgatttcgtaggcaagttcgagagcatggaggacgatgccaacttcttcctgagcctcatccgcgcgccgcggaacctgaccttcccccggttcaaggaccggcactcgcaggaggcgcggaccacagcgaggatcgcccaccagtacttcgcccaactctcggccctgcaaaggcagcgcacctacgacttctactacatggattacctgatgttcaactattccaagccctttgcagatctgtactgaggggcgccgcagctggccggggccgccctgccccggtcactcacctgtgctcccgggcatcctcctgtccctggctcctcatcctgggagcaacagggctctgaggacgtgaggagccatcgctgtgggaggcagcaggccccgggtggggggcagaggcgcccagccttggatggggaccccagcccctggcctgtacctgtttcctcattccttggctgagggagaggctgagaactgggcagacacccctggagctcagccgacagttttgatgagcagggaagtctgaggcccagaggacggggggcccagcggtaagggatgtcccgcactcccttagccattgccttggaccaaaccacgtggtttgcagcttttctacgagccaggggggaggttcccttggattaaggttccaaataaagcacatggtttccagagca

SEQ ID NO: 114121 - DNA, 1040 bp, Homo sapiens
  Payload ID: 2300
  Gene Symbol: CHST8
  Gene Name: carbohydrate (N-acetylgalactosamine 4-0) sulfotransferase 8
  ENST ID: ENST00000591231
  CDS Start-End: 506-1040
ttcgctgggagccttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccaggtttaaaggtcaacaagaatatcttaccttaatttgacaagtacgcaagaaataatgcaagactcgtttatgttcagatctcggcctgatggacgcctggtgtggacgatgagggaagaacgtgccccccacacccaagaggtgacccctgagccagccccggatgaccctgcgacctggaacaatgcggctggcctgcatgttctcttccatcctgctgttcggagctgcaggcctcctcctcttcatcagcctgcaggaccctacggagctcgccccccagcaggtgccaggaataaagttcaacatcaggccaaggcagccccaccacgacctcccaccaggcggctcccaggatggtgacttgaaggaacccacagagagggtcactcgggacttatccagtggggccccgaggggccgcaacctgccagcgcctgaccagcctcaacccccgctgcagaggggaacccgtctgcggctccgccagcgccgtcgccgtctgctcatcaagaaaatgccagctgcggcgaccatcccggccaacagctcggacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgcccc

SEQ ID NO: 114122 - DNA, 1654 bp, Homo sapiens
  Payload ID: 2301
  Gene Symbol: CHST9
  Gene Name: carbohydrate (N-acetylgalactosamine 4-0) sulfotransferase 9
  ENST ID: ENST00000284224
  CDS Start-End: 98-1174
gggagagtggagaagagaagagaacaaaaagtaacttcaggatggggaccagtgaagtacttgcggcctgtacccagaatcaaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaag

SEQ ID NO: 114123 - DNA, 2043 bp, Homo sapiens
  Payload ID: 2301
  Gene Symbol: CHST9
  Gene Name: carbohydrate (N-acetylgalactosamine 4-0) sulfotransferase 9
  Uniprot ID: Q7L1S5
  ENST ID: ENST00000581714
  CDS Start-End: 230-1561
agtcttttctgtcttcagagcattagtgtgcacattaagtcttcagccttgttgagatagtgaatatttatgccgtatttgagaattaatattagcagaaatgtacaatgtagatttctttttaaaattctaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtg

SEQ ID NO: 114124 - DNA, 2033 bp, Homo sapiens
  Payload ID: 2301
  Gene Symbol: CHST9
  Gene Name: carbohydrate (N-acetylgalactosamine 4-0) sulfotransferase 9
  Uniprot ID: Q7L1S5
  ENST ID: ENST00000580774
  CDS Start-End: 260-484
cccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcaaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaag

SEQ ID NO: 114125 - DNA, 11388 bp, Homo sapiens
  Payload ID: 2301
  Gene Symbol: CHST9
  Gene Name: carbohydrate (N-acetylgalactosamine 4-0) sulfotransferase 9
  Uniprot ID: Q7L1S5
  ENST ID: ENST00000618847
  CDS Start-End: 279-1610
gtcagggccagggtgagcgcccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtgatattttggacttaggcattttactttagattggaaggcattatgtgatttacaatatgagaatatagcagaaaaaccagatgaggctgtggctttttatattcaacagccaataaaaaatgcacaacatgctaagatcaaagcaacaaaaccaaccttcttcttccagaaaaacttaagggaattgattctgttttcttttgagccttccacaaagagacaaaatgaacacaagcactaaaggtctacatttctgaagcaggcagttgagaagcttaagtctcatcagatataaatgtgctcctaattctggtttaattgagcaggggggaaattgtttcaggatggaataatcatcaaaaacaaaagttgccattctgaatatggaactcaaacaataacaaagttttataagtatattatttgaatcaaagcatcatgtgcatagctttatatgtggaatacaccctaagaatagcttttgttttcagtttaattattcagcttaggaatgactttttaaaaactaatataccacttcaaagataggttatgttctagagaataaacataaaaagagcccctagaaatgtgtttaataggcttatgcataagtaaattaaggtattttctttttaagtttaaatattctatactaacaaagtcagataccattgcattcaaatattaaatcaaagtccttagaaaaataggtccatgtgtcacccttatgaatagttgtaatgcattttggaatttttttccaagggatcctaaattagatcccttggggaaaaaaaaagggatcattttggatgggaaacatttggatgggaaacctactttaattggtcgacttttaccccgagttaagaaaatcacaagtctttcaaaccctgcttaaatgcttttcctgaacatcttcctcttcctaagctatcatttttttcttatcagtaaatattcagtaatggctttcaaagaacagtaggtattaatagttgaatgttaatagaccaagatagttgcagtcatacttatttcattttgattttctatttcatggctgagtattcatgaattgcttcgctccttacacacacctgccgtgtcccatctgtgtctcctaaggagtaagtaaactgcaatgggctgagagatcaaaagtattaaaccttctaatccaaccttttactacttttccatgccattaactcttgcctctagaccatacacttaagctgtgctctcagtttttaagacgttttactctggagtaatctaaattacataatttaaaattttgctgcaccatgtagagtagattcctagtaatttagggaaattgaaattatctttttatggagagagaaaataaaaaatattccagaagcctgaaattttattcctaagaaacacaaaacttgctttatatgaaatccactataaagaataaaggcaatttcctcaaaagtattcctaaaactatataaggaacagacaaagaactttcaatagctttagaaggaaaaaaatggaaacaacagtcctacctctcttattggcatttgtaatgcattgggcagggtggaatgcatacctatataaatgtttggctttgatggtggagaggagggatgagtggaagaaaatgatacccagtgttctctacggaaagctgtattgtaccttttgctgtatatgttcctttcctgaccctttccaacgagcccgtgtcaccatgggtcattcttttcctaaatgggctctatgatgccaagtgacaccctgtgtagttgcaagttccaaaagccatgcatgtctttgccaagtaagaacaaactttttatgtacctgctcttcattttagatggcttattttcatgttaggaccaaagaagccagtcatcatcctggattacttgtgagtttaaagccaaactccatttttctctcctgacttatttggccttgcagaccagctcacattcacctttgtcatttctgcctgtgcataaatccaggtgggaacaccactgttctttaggaccatcacaatttcatgaatttaattcctaaaggcaagtgaccaaatccagactcatcttccagatgtccaaagttcccattttaacattaggtgcaattataagtcctccaattaaaccctaaggatcctatttgtttttataggcagcagtaacacaatgggcagaccccttcgctctgttattcccctgtctggaattactatcagggtaacaagttggcaattaaatccaaaaccacagttatgtaacctgtaaactatctatagatgtgcaatattgatgtgattgtgcccagaaactgccataaacttcaatggaaatgtatgtacaggacatccagttttcggattttctcaaacatttggaaatatccattaattcaatggaaatgtgatgccacttgctagatgtctataaaacattctgtaacagaaaataataatattattatcattagggaattagtagttctaattcaagaactacttgtatgtcatttttaattagaaagaggaaaaatacttttacattttattgatgtattattattcttatctcctaaaatgtatagtatttagcagaaggtatatataagaagatgcagagaattttgaatattagagtgccctttgaaaaaatcacttgctgaattaatagaacttgggattaggctaggactacagtaaacgtctccctcctgtgcattctcatgtggcctctcagggcatcccagcctctaggccttcatggggcgtggtgaagcagatgttttgcccagggctaaccctcccaagatgctctgatacttgaaaaaggattggccaaaggcgtttaattatagctcaactacctgagaaccttaggccaaggctaattcaatttagtcctacatttaggctcataccttctcaatctcaatcatgatcattatacagtaatcgtatgcatgatcctagctaacatttattcaatacttactgggtgtcaggcactcttcaagtagtttacatgcattaatttaatctccatagccagtctaacataggtaatattatgtagccctctccctttccatctatcataaaggaaagtaaagcagactatagctgagtaacttgcctaaggagacagagatgataagtaggtcagaagccaggatgaagccaagcagcaaataccactaccaaactctttgcttagaatattacaaaccaatatttacttttgctttccgttacctctattcaggataggtagaggcaaaaacaatatattggaatcctgaaattttttccatacaaatatgggtgtctgtgtgtgtgtgtgtgtgtgtgtgtgtgtgtgtgtgtgtatttagctagttagttatcacatttcaaatcagcttatttctttattcctgctgagttaaactgacaggttcaaagactttggaagaaattaggtttcctccccacaacttttttgtaatccttagttaatcatggaaacaatgtttttaagaagaaaaaatagtccctggaacaaatttagccttgtgaaaacaaaatatcatttctttgacaagaaattccagacagctacaagaccagtcaaggataagcagaatctaagaggaagaaagttcaggcgaactttccacacataggcccctgacagccactgcagatggtcacggttcagcaagctagtcacacacagtgagaaccactcctgctagaaacagagcaactgtgcattatccccttcttcctgagtctccttccctagtactagtttgtagtcagattaccctgagcctacacgggaagactgcagaaaagaatagaggagcaagctgacttaaaccgactgaaaaaacaccatgaaaccaggtgaaaataaataagctcttgctagaagatggcagacatttcccaggcctgtgatcattacctgaggaaggccaggtctggggagttcaacagaacattgcctcatatcatttcattctcagaatttcctagtcagtcacatcttagtttttcaccaggatcatatgcttccaggcaaaagtatttaaatccatttaagcagtcatctttttccatccctaaacctctcctcaagtctcacactatatttggaatgctcccctctctatatatctggacattcatttcttgttaactcaccaaggaatctcttgagattattcaatttcaaaatctcatctctttatgagctccctgataggcagaaaaagacagcagagttttcccctggtgtaacatgcatcagattattctcttaccaataaatgcaggcattcctttcctcgattttttttgtcagggaggttcgttaatttatttgttcatgtgctatttatctcactttttatgaatataaaatatctgttgttgtcattggaatgtcttaggtcttccaagaggaaaggaactgtgtctgttgaatgcactttgtaccatgtctagcaaggcactcagtggaaagcgttactttaacagatgcttttgatgctgttgtttaaaggttcctgtacaacttcttttagtgtagaattcgtatatttctgcctgtgaccttcaggcatctataggaccagaggatctgaaaggaaggtgctagagcagggcagctgagggaagggagctgagccacacaccttttctacactaatagtcatcccttgacctgaaggatagttgcagacacagaaatcttttacatttctaagaaatagcagttgcttgattgtttggggaagaaaattttgagaaaaatgcatgattctggtcaacataagagccatttactgaggatctactcagtagcagacacgggaaaaatactttgcatacattcatttaatgacatgaagagtaagtctaaccgtttccaaaagtagctttcaaaaaaatcaaagtcgagtatttttccacctatcatttcatgaatgagaaaactgagtatcaaagaggtttaataacagtctctctggctccaaagctgagaccatacattggcagcccacggggtagatctggctacagatatgtttggtttggctgacagtgcattttatttaacatctgaattagctgccaacattgggcctcattaatgacaggggatttgttaccctacattctatatgcccacctgaaaatagttggacagaggcaaggtcagtccctttagatgaggttggagatctctagttgttcacactcttcactaatccaccatcactcattcaccttacttgcctggcccctaagcatctcacttttcaagtcctgctctgaagagtgtattccttcccccgccaagcttccaaaggaaatcaactcctgaacattatccttgaccctatttgtgttgtgcaggtagtgaggttatcccattccgggtttccatatccttgctcacagtgctgcttgccctttggtcctatatccagtgggatctccaaacagtatttcattgtttggggaagtctcttttgaccaatgacaaagatgttgggagaaatccagtacctttttttggcatctttctgtcgtagccactgggtcccctggcaacgacattccttcccacctctttctgcagagatgagtcattctcccaggctcttggagctctagtatctagggacagaaactggctcccactgctgcctctagactgctgttctataaccttcatccaaaaatctcttctgttttgcaggtgtgcccgcttcctcaactctaaaaatcacctgcttcccagccttctccgaagattcttctttctgatttataacatgcctctccaccctacttcctgctattatctgggtgattgtagcaccccctgtaacattctactctcttgcttcttaatgctctgacaacctcctcctcctcctcttccctcctcttcctcctcctcctcctactcctcctactcctccccccacttctatacttagagaggtggagaaaacaggagaagggataactacgacttttgtcctcaaataccaggaaaactagtaaaacacacagtatctcattttatgcattcatttgctgaaaatatttccaaagtttagaaaaatgatttttggatgtactatataataaataaaaatgcactcagaatgctagagtgtctaccaacttaaaagaacaatattatttgtttgactgtgattatccttaggaaaaaataagccctgatttaacttatcaatttctgaaaaaaatagtgtatggacgacctgtatcagaattaacctaatttttgttaaaaacatattcccagaccccatccaagatacacagaattggaatctctatgaaaaccacctgaaaatttcctttttaataatctcttggggtacttctcgtgtgtgtgtgaattttttaagtcctggttgattataaatgataatacaacctgctcttttcattctgtcactgtgttgaaaagttaacaactctcagctcagagaattgtcagtgggtattggtaccaaagtcctctgtgggattttgaccagcactgaagcagaaacttggcgtccgaagtctgccaagtgcaagaactagagctgaaatgatgaagtgagggacggggacagcactgggcactgcccaaactttttgaaagctttcagaatgaaatggggaaatggaaactttcctctgtttgaaatataaaagacaaatgtgtactgaaggcaattttggcaactcaacttcacattgaacaagtgaagacaatatgagtttctccaataaaaactaaaaagctgttttcaaattgacctaagatgattgaaaatggaaaatatttgctatttggttattagtttgagagcaagtgccccaggaaatattttgcaatttaacttaaatggttataatgtatattttcttgaacttcattaaaggatttgtctctttttgcctttctattaggttgaaccatatgacattgccaacatttgactgactctgacatataaacacagccctttcatgtgggtccactaacagttctgctgctacctacccaattctaaccacattggctctcctcagaactattggaaatagcctctgaatagaagtcctgccttttttatttatttatttaaaaattacttcttttctctttgcatttttcttcttttgatattttcaattgtggcaaaatccacataacataaaattttatcaccttatcattttttggtatccttttaatgaatattttcctatccctccccatcttacctatttttttttttgagacagagtttcactcttgtcgcccaggctgcagtgcagtggcaccatctctgctcactgcaacctccacgtcctgggttcaagctattctcctgtctcagcctcccgagtagctgggactacaggtgcacagcaccacgcccagctaatttttgtatttttagtagagattgggtttcaccacattggccaggatggtctcgatctcttgacctcgtgacccatccgccacagcctcccaaagtgctgggattacaggcatgagccaccatgccttgccaccattttttaagtgtacagttcagcagcatttagtgtagttgtgcaagcatcaccactatcccatcacataccttccttccttgtgaaaaatggatactctgcacctattaaacaacttcactttttgccctcccccagttctggcaaccatcattctaccttttgtctctatgaatttgataacttaaaatacctcatataaatggaatcatacagcatgtgtctttttgtgactggcgtatttctcttagcataatgtcctcaaggttcatccatattgaaggacgtaccagaatttttttcttttcaaggctgaattgtattccattctcattgcctggcctcaatctctcaagactataacccattcccagcttaatcacctgatagctgcatcaaacccactattatccagccacatggaaccattacattctctgaaaacacctcttgctttttcccctattttgctcacactattacacgacctgaagtgtcctttattcctctttaaggacctccacatgggtgccccctccaagagttgcctgccccgcatgaccatcccacattcagctcgctctaccctctctgcttggggactctcttccactctccttgctttagctccaccattaggctgatggttccgaaatctttttctaggctatgtttctatcacgaactttgattcagattcccagtttcttgtgggactgcttcatctagatgtctcactggagcttccaactcaacatgaccaaagctgaactcatcacctaacccccaaacctgctttctccttatttggtggcaacaccatccatctactccatcttctgagttaggaacctagaagtcaaccccgatttctccctaagctgactcctcacagccacagaattcagaaagcccattaacttcactgcctgactttttctcaagcttctcctctcctcccatccattctgctaatatctaagttcagactctcaccttctcctgtctacaactctacgataatcttgaacttctctcccactctcatttccctcaatgccatcctccatacagctgcccttgtaatcactttaaaatgcaaatccaattccagttctgtttcccactatacattctatatcctgcatgatcccaattcttctccaggcatatttctggccattttctgcctcctggcttaatctccaacagcctagaatggacataataccctaacattggatagttttcttcctcctgggtctactcagcttgtccctctattagggcacccacctaccccccttcacctccccaacacttcctaatccctaaactaagctcagggaggcatttgtcatctctgcctggctcagatgagatgctctgccctgagtactatgagagattgggaagcaggattctatgtaggatggttaggagcctggggcttgtcatgagtaagaactgggtttgaattccgtatcctcaactttcaaatgttgggacctctgaaattgctttaacttctctcagtgccagttttctcatctgaaaactgaggatagaatacctacctagtaaggggggtatgggaaatgcatgtaaagtatttaataagtgctcaataaaataaaaccattgatttatctca

SEQ ID NO: 114126 - DNA, 4810 bp, Homo sapiens
  Payload ID: 2302
  Gene Symbol: CHST15
  Gene Name: carbohydrate (N-acetylgalactosamine 4-sulfate 6-O) sulfotransferase 15
  Uniprot ID: Q7LFX5
  ENST ID: ENST00000346248
  CDS Start-End: 644-2329
gtcccctccctgcgccccgccgcgtctcgggaggcggcgtgactcgggagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaa

SEQ ID NO: 114127 - DNA, 4820 bp, Homo sapiens
  Payload ID: 2302
  Gene Symbol: CHST15
  Gene Name: carbohydrate (N-acetylgalactosamine 4-sulfate 6-O) sulfotransferase 15
  Uniprot ID: Q7LFX5
  ENST ID: ENST00000435907
  CDS Start-End: 652-2337
gtcactcccaaacttttcctcccagcgctcggggagtcaggttgacgcgccctggatgcggggctagaggctcggggctgggcgcgctcccgcggagccggagccgcagaggctcccgggctggactcaggcttctcaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaagc

SEQ ID NO: 114128 - DNA, 3553 bp, Homo sapiens
  Payload ID: 2302
  Gene Symbol: CHST15
  Gene Name: carbohydrate (N-acetylgalactosamine 4-sulfate 6-O) sulfotransferase 15
  Uniprot ID: Q7LFX5
  ENST ID: ENST00000628426
  CDS Start-End: 604-2124
gactcgggagttgccggcgcttcccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtaccccccccccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactgatgggctcttggtctggctcctgccttcctccctgctggtcacctgccacctccccctcctccctcagcaggaggatgagggtgcctttaggaagattaccatttagcaagacacccagcaattagaatcggcagacatgaggacacccaactctcaaattgtcttaagagcattctcttgagcggtggattgttttgttggtttaaaaaactacccatcaatgattttcaatgcttctttgacagagtctcaattgaaaaacattttctgttgattcctcaatcgtatctcttgttcttccttcagaactatgtctgtaaatttctagcctttttgaatgcaaaaagctgttattggtgaattcagcaccttttagccccgggatagttttccatgctgggctccctgggctggctgtgtacttcaacagcagggcttatgcagcgagcattgccgctgcgtgttccagagtggctttacaagccttgctctgctcagcgtctcgcatagcaaggcaccaacaggcctgctgtggagtcttggaagcccccaggtggtgggacttcaggccaagaggctctgccccctctttcttactacagaggccgtgggatctgggaggcagcatgcaggggcagcaggtgggattccaggctgccctgttggactttgtagtttggcaaggaagatgccacagggacacaggtaaccccagagcctgctctggtgccaggtaggaggagtacactttggaaccagccattggtgtgggtcaggtttccagcttggccatttgctggctctgtgactctaggcagttgtctcagcctttctgagactcagttgctttgtcatacaatggggtaataatgctgctgtaccaggctgttgtgatgggtctgtcttgcattcctgcgttcattcttgccactatgtcccctgcatgacgctgggtcctggggccacagcaatgccaggacaggtgtggtccttgccttcctgtgcagctggcggggagagaagatggaggctgggcagggagctctggccaccagagaaccacctgagaacggggcttcaggcaggttcttaggagagggaatgtctgtgctgaggcctgaaggagagttggccagggaactgagagcagcgtgtgcagaggcccagtggtcagcaccacctaccatacagaacgcagccagccgcctggtgtgggagatggggggcactgaggcagggggcttgggtgcgtggcacatggggccgcaccacctggtctagcctcagaagaagtctagacatcaccctgagagagatgggacccctcagagggttttaagcagaagatagtgtaggagtggaaaaggaatatctcactactgtgttcatggctgaggcacctataataaaagactaacgcgagaaagca

SEQ ID NO: 114129 - DNA, 826 bp, Homo sapiens
  Payload ID: 2302
  Gene Symbol: CHST15
  Gene Name: carbohydrate (N-acetylgalactosamine 4-sulfate 6-O) sulfotransferase 15
  ENST ID: ENST00000462406
  CDS Start-End: 627-826
cgctcggggagtcaggttgacgcgccctggatgcggggctagaggctcggggctgggcgcgctcccgcggagccggagccgcagaggctcccgggctggactcaggcttctcaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaa

SEQ ID NO: 114130 - DNA, 2412 bp, Homo sapiens
  Payload ID: 2303
  Gene Symbol: CHST4
  Gene Name: carbohydrate (N-acetylglucosamine 6-O) sulfotransferase 4
  Uniprot ID: Q8NCG5
  ENST ID: ENST00000338482
  CDS Start-End: 344-1504
acaattgaaatcaagtcaaggcaagcaccacaggttcttgtcatttgtgcttagcggacttagctgatggaaatcggcaaagatcatcccaaagctcacacaactccctgcctgctctctctctcttccaagggagttgaccttcacagttgcctttcagtagtcaacatgccaggatgcctccagtctgggggaaaatgcttcctcatttgcttctcccagcccacctcaagcagtctccccaccccttgagtctcagcagtgttaaagctgttactttcacagcttcctgggagcgagtgctttctcaagcccgtcttgcaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgtttagaatgtccctttttatgcttcttaattattagcagtaaatgttcatttttatgggatcctaagctaagaatagatgtaatcatctttattggttttttaaaacacctttgctattatctatcacccatttatacagaaaattgctaagataatatttggtttcagatgatgaactaagtctataccctcttaagaattggtggaaaatagacaattagcagct

SEQ ID NO: 114131 - DNA, 2183 bp, Homo sapiens
  Payload ID: 2303
  Gene Symbol: CHST4
  Gene Name: carbohydrate (N-acetylglucosamine 6-O) sulfotransferase 4
  Uniprot ID: Q8NCG5
  ENST ID: ENST00000539698
  CDS Start-End: 264-1424
gttaaagctgttactttcacagcttcctgggagcgagtgctttctcaagcccgtcttgcaaggtgggtccttttttgtttttggcagaagggagggacagtgaaatgtgctctgagtagggacggttatgcaaaagcaagtaggaggaggaagccaagaggggagttggtgagtcagaggagaaaagcgcatggcccggctagcagtgagcctctcaaaagcagcagggaagcccaagccacaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgtttagaatgtccctttttatgcttcttaattattagcagtaaatgttcatttttatgggatcctaagctaagaataga

SEQ ID NO: 114132 - DNA, 3245 bp, Homo sapiens
  Payload ID: 2304
  Gene Symbol: CHST5
  Gene Name: carbohydrate (N-acetylglucosamine 6-O) sulfotransferase 5
  Uniprot ID: Q9GZS9
  ENST ID: ENST00000336257
  CDS Start-End: 1396-2631
ctctggctgctgctccagctctggcagacacgccaagctttgagaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggtgagtcccctcagctggccaggacagtactctgctctcacctctctgcttcttgggctccatcccagctccccatcaactgatcttcttgcaaacccacagggctccaggacaccctccttctggagcccatgctgcctacagcacttcactccccaccagtgatgacaacagttgctgttctttgtccactttatttacttgtttatctttaatgacaaaagttttttttttgttgtttttttttttttttttgaaacggagtctcactcttcactcaggctgcagtgcagtggcgcaatctcagctcactgccacctctgcctcccaggttcacgccattctcctgcctcagcctcccgagtagctgggactacaggcgcccaccatcacgcctggctaattttttgtatttttagtagagatggggtctcactgtgttagccaggatggtctcgatctcctgacctcgtgatccgcccgcctcggcctcccataatgctgggattacaggcgtgagccaccgcgcctggctgacaaaagttttatacctgcctgttaaaaaaattatataatacagaagcacaccttgtaaaaggtgcaatcctcagttatgggcatgactgcgtgttcccttcccccatcttcattataataaccccccaatccccccagatcctgtgagccaggtaccggaattatccctctttcacacacgggtaaagtgatccgtcacagagagatttaagtgatcttcataagcaagatcataggctaggaagtggcagagccaggattcaacctcggcgagcctggtggtgctctgacatccaccgaagcccccatcaagcccttttagctccacaacctaaaagggtctctctaagaggtatcctgaagcaaaagacaggagttctctttgaaacatagtatttctctctacagatagatagcctgtaggtatgtaagtaggtgggtgggtgggtaggtagacagtttgatgatatcccacattattctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggatgggcatgagggcccgggtccctaaagttgcccactccacccgaaggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcgaaaccagcctggccaacatagtgaaaccccctctctactaaaaatgcaaaaattagtccggcgtggtggcacactcctgtaatcccagctacttaggaggctgaggtgggagaatcacttggactccagaggtggaggttgcagtaagctgagatcatgccactgcaccctagcttgggtggcagagcaagactctatcaaaaaaataagtaataaatttgttcaaaagtcc

SEQ ID NO: 114133 - DNA, 514 bp, Homo sapiens
  Payload ID: 2304
  Gene Symbol: CHST5
  Gene Name: carbohydrate (N-acetylglucosamine 6-O) sulfotransferase 5
  ENST ID: ENST00000565039
  CDS Start-End: 217-514
aaagagctggctgtgcggtggaacttggaagagacgacgtctgggagcttttgctgagcccagggggagaggcgtccctctggctgctgctccagctctggcagacacgccaagctttgagaaagctcccagtgaggaactggtcttctggagactctgtgtggcatagagtgattcaaccaccttaagaagacctctggctttcctggaacacagatgtcgagacatctcccatggatttgtgatcagcgttgcagctctcccagcagccctggacggtggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagc

SEQ ID NO: 114134 - DNA, 7957 bp, Homo sapiens
  Payload ID: 2305
  Gene Symbol: CHST6
  Gene Name: carbohydrate (N-acetylglucosamine 6-O) sulfotransferase 6
  Uniprot ID: Q9GZX3
  ENST ID: ENST00000332272
  CDS Start-End: 181-1368
gacgacgtttgggagcctttgctgagtccagggagagaggcgtcccccaccgtgccgctgcagctcgggcagagccgccaagctttggggtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgcactcttcatggaaagcaactcttgcccctcctcctctgggcacagggtgtgcgttcagatgacttggctcctactcaagggctttcttcccctttaactctctccttctggtgacacatcctgcagcagctgagggggtgccctggcactggctgggagtggagaggcactgtggtgaaatggctccagaggtctgtacatcacatacatatgcacacaggcacacatggcaaaactcggaagtgaaaggacttgtctgaaatcacatggtgagaaggaggatgaagggaggagagagcttttgctctgggtctccagtggataggagaggacctgcctcctgggtgagaagggtcagattttcctattttaattgctttagggaagagcaagcagagtcatgaccagggacacagctgagagatagaggaggctgtgaatgctgagaccagagtttatcatgctggacaagcctggaaggaggcaataagtgggaaaggtaggaggagagaaggctggggagggctgggcagcaagccaggcacagtgagtggcagagcaagagggggaaagcaggatcagtgcctggaaggcaggtgtgcccgtcagcggggagtggaactcatcaggcttgccaagaggttggaagggaaatggctctgggctggaactgtcttcccttggtccttctggtccaggccttggaggaaagcagaggatgatccctgcctgtgagccacacctcctagctctgggggcaaaggggcttagtaaaggaatgctggatgtgtagagggtttagtcccgagctcaggaaatgagagcctataagtgcccagtacatgtttaaaagaagagctcatggaacctctggaaaggacagggaagttgagttagccacataaatgaacccaagtcacattggaacacagagctggtctgggaactgtgttggctgccaacagaacttctgaccctgttacctgtgaaatgaggcagtttccctcacgttgccatcagctaccaggagcgatgctggtggtcactagcttctgatcctcatcctgggtgtggccacagattgggggaacctggattgtggagtcacatcctccctgcaaagcaagcagggcaagggagatctggcattttctgctttacgtggagggagaacaggcacattagccttgaagctgaagctcattttaggttccttccaggtttagaagcttcaaccaaatgaaacttgaatctgtccctcgtgacaattataggaggaaggtatttaaaaccccagatttatgaatgtgtactacatggcttagagaatgtctttgttcttgttcaggtggttataacaaaataccttaagagtgggtaacttggctggatgcagtggctcatgcctgtaatcccagcactgtgggaggccgagggggatgaatcacctgaggtcaggcattcaagaacagcctggccaacatggcgaagcccctcctctactaaaaatacaaaattagcgaggcatggtcgcacatacctgtaatcccagctcctcgggaagctgaggcaggagaatcgcttgaacccaggaggcggaggttgcagtgagccaagatcacgccattgcactccagcctgggtgacagagcaagactccatctcaaaaaaaaaaaaaagactgggtaacttataaacaaatgttcttctcacaagtctggagactgggaagtccaagatcaagccaccagtgctgtctgatgagggcccactttttcaaagacagtgccttctagctgtgtcctcttatcgtagaagatgggagacagctctccagggccatttttttttttttttttttttttttgagatggagtctggctctgtcgcccaggctggagtgcagtggcacaatctcggctcactgcaacctctgcctctctctgcctcctgagttcaagcaattctcctgcctcagcctcctgaggagctgggactacagggatgcaccaccatgcccagctaatttttgtatttttgtagacactgggtttcaccatattggccaggttggtctcaaactcctgacctcaagtgatctgcccacctcagcctcccaaagtgctgagattacaggcatgagccactgtacccagtctccagggccttttaaagaatgtcactaatcccattcttgaggtctccaccttcattatctaatcacctcccaaaggctccacatcccaacaccatcatattgtgggttaagatttcaaccacaagccaggcgtggtggctcatgcctgtaatcccagcattttggaaggctgaggcaggtggatcacttgaggtcaggagtttgagaccagcctggccaacatggtgaaaccccatctctactaaaaataaaaaaaattagccgggtgtggtggtgcacacctgtaattccagctactcaggaggctgaggcaggagaatcccttgaatccaggaggcggacagtgcagtgagccgagataatgccactgcactccagcctggatgacagagcaagactccatctcatgcccagccagcatgcccaacaagcttcatttgcccctgtttaggtcacaaattttattgatggctgcaattaatggcctcttggtatccaagtcctttgttgtatgacccatccattctcccctgactcccaaggtgtcaggacatgcttgactggctcctgaatttgctctctgcgcatgggcagtacagtcaagcctcacagtgaacccaggtcagctttcaggacaaagaaagtggcctggctgactaggcacagtaaagccagggctgggtaggtacatacttgtgctgatcacgtatgtcttatatctctgtgagagtgcagtcccaacaggaaggtttaatcactggggactgcccaatgctgtgacagggcacagagctctgggttgctgtgggggtgactgcattgaccactgttagtggtttgctgtgttgacactctgtgctgtgtgaccatggctcctgccatcaagaagtagagtctgtttctccacctctgaatccaggctggtcctgtgacttgctttgtcctgtagacaagtgtagtgcaacttcctgtgagccagtttgaagcataggccttggaagcaaaactttacctccacctgtcttaggttttcagctggggctctgctgtgatttgattgtgtctcccaaagttggaaccttgatccccagtgttgtgaggtgaggcttgatggaaagtaaattacgccgtgcgggttatgcccttgtgaatgggtagagaacattatttctgggcgcaggcatggtagctcatgtctgtaatcccagcattttgggaggttgaggtgtgcggattacttgaggtcaggagtttgagaccagcctggccaacaaggtaaaacaccatttctagttaaaatacaaaaattagccaggtgtggtggcacatgcctgtaaggccagctacttgggaggctgagacaggagaatcgcttgaacccaggaggcagagattgcagtgagctgagatcgcaccactgtactccagcctgggcaacaaagcgagagtctgtcttaaaaaaaaccaccattatttcaggagtgagttggttatcctgagagtggtgccttttaaatgaaggagttcattctttgtctttctctcgccctcactttgcccttctgccatatgatgccttccatcatgctaggacacagcaagaaggctctcgctagatgctggctccttgatcttgggcttcccagcctccagaactgtaagccaatacacttctatttattatatatgacccttgctgggttcagtggctcacgcctgtaatcccaatactttgcaaggctgaggcaggaggatcacttgagaccaggcactcaagaccagcctgggcaacatagtgagaccccatctctacaaagttaaaaaaaaattagcagggcatggtgtcgtgcacctgtagtcctagctacttgggaggctgagttgggaggactgcttgaccctgggaggttgaggctacattgaaccatgatcatgccagtgcactccagcctgagtgacagagcaagacacctatctctaaataaatgaccccatctgtggtattgttatagcaaaacaaaacagattaagagagactttttaatgaaaagacagattcacaaagaaaaacaatgtttttgtttctgtttttttgaggcagagtcttgctcttgtcccccaggctggagtgcagtggcgccatcttggctcactgcaacctccgcctcccagtttcaagcgattctcctgcctcagcctcccgagtagctgggattacagatgtacaccaccacgcccggctaattttttttgtatttttagtagagatggggtttcaccatgtcgatcaggctgggctggaactcctgacctcaggtgatccacctgccttggcctcccaatgtgctaggattacaggcatgagccactgtacctggcgaaaaacagtttgttaacacaggcagccaacatcactcaggataagcctcaatgaaaagtaacaaagtgatggcttggaacactgtcttacacagcatttttaaaaaatacaataaatttgtagagataggatgaccaaggacaacagttttaggcttccaaaggtggtaaactatgggatggtaaatatccgagaggaagctgatgcaacaggatttgtctgcagcagcctctggtaccacctctgagtcaagggttgtgtccagtgatggagagtttatatcgtgcctttaggcagaaaaggggagggaaacctgaacttttcctgcactttctgcttcttaattgccttcagctgaaaatcattttttatgtgaaaaaggcatagtctgagctgacgcctctgctttcctccacctgaagagaacctgcgtgctgctcctttgcttcggacctccgcctctgcccgggagaaagcccaggccagcctgctggacaagcagagaccatgagaaggagagttcaggggtcccaaaccaggccatcctagaccagccagctccagctgatccgcacgcagccacttcggctaccttctactggccaaagggagtcccagggctcacccagattcagaggtggggaaactgagtccaccacttgagaagagtagctataaagacatatgagcgaggccagctgagcccagcactgcggccaagtcgaagactttaggagcaataaaagtgcttattgtgtttcagtcatttgagtgttgtggtggtttgttacgtagcattgcctaaccgatacacttgagaacggagggctcctggcacctgcagcttccaatttccaccagggtccaggctccctccctgctggtagggctgtaattagtgtctccccttacctgtaggccctgtgatgcagctagaagtgtctaggcccagcagtcacccacaattaggggcaggcacgcttgctgcctctgctctggctgtgggagctcagaaggggcaatcaaagcactagatgggctgatgggtgcatagaaacagtgttgcctggaataggtcagagaacccacctatcaagaggctgttggggaatcaatggtgggccttatttttgttattttgcatcaagaagatatattatccacatcaacactgtatcaactcctcatggccaccacagaccctgtgtcccctagctttgtctttgatgtgcctttgtcacccactcctacagactgcgccccaccactgccacaactgccccatcacctctacagggttaaatcaatggttttaatttttgcctacctgatgggtgaaaaatgttacttgatgtttcagtctgcacttctttaattcctggggcagctgaacatcttttcatgcttatgactcaactgtattcctttttcattgttcaaggctgtgcccatgttgctgttgacttaccacagcctcttttgaatatgctttgttatttttgttgtgcaaatggtttctcctagcttgtcatctgttttttgttgttgttgttttgttaacttactttatggcattttcccctcaggcttcttaaaaaaaaagaagcttcattgagctataattgatatacaacatctgcacataaagtgtaaagtttgattaaacatttgtatatacctgtgaaatcaaatcaccacctcatcacaatcaaatttcaaaaagtttcacctagtttatcatattgttgaatgtgaatcctttccttatggccagtggattttatgtcttgttgaaacgactttgtcctgctacagtgataaaaatggtcttcacgctt

SEQ ID NO: 114135 - DNA, 2093 bp, Homo sapiens
  Payload ID: 2305
  Gene Symbol: CHST6
  Gene Name: carbohydrate (N-acetylglucosamine 6-O) sulfotransferase 6
  Uniprot ID: Q9GZX3
  ENST ID: ENST00000390664
  CDS Start-End: 693-1880
caccgggcagcgccgagggttgccggccggcgcgcggggagtagagggcgcgggccgcagtgccgggttccagagggagctctgcgccgggtccttccctgtggtagccccaggacacccccagcctcaacatcccattctgggactcctgccctgttcccacattcgttctacctcgagtctccaggagcttccagtggcttggtcaccgccaactctcgtccatgcctcttagagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctgagtccagggagagaggcgtcccccaccgtgccgctgcagctcgggcagagccgccaagctttgggttctctagggtgtgtacccaggagtggatctgctgtatcatatggtcactctattcaacctttcgagaaaccaccaaattgtttcttcaggaaatgcaccatctgacatccccattttatgaggatccccacgtctctgtcatctcaccaacacttgtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgc

SEQ ID NO: 114136 - DNA, 2289 bp, Homo sapiens
  Payload ID: 2306
  Gene Symbol: CHST7
  Gene Name: carbohydrate (N-acetylglucosamine 6-O) sulfotransferase 7
  Uniprot ID: Q9NS84
  ENST ID: ENST00000276055
  CDS Start-End: 149-1609
aagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgacagtgcaatgtggatatttatggctgtaaaataggaagagctttagttcccaggctgaacctgccactgctggagccatttcaacaaggcatcctcacaacaaagaagagatgtgatttggtaccatttcacaccagcaggtgtctggacgaaaacatcaatgtgaataagggccaagtgcagtcctgtcttgattaaattacttaataatattattaaataataataggtctgggcagtattgtttttaacctgactcatccagctgtccttcaaatagctccgtctccctctacccagaactgatttttaaaaagaagtaatttttctccctgggctgggaaaaccctaatgaactgaaacacacttttactttaaaatttttctgtctggcgtttttgtaatcatactattaaatgactctggagtcatgttaatgacagga

SEQ ID NO: 114137 - DNA, 4582 bp, Homo sapiens
  Payload ID: 2307
  Gene Symbol: CHST2
  Gene Name: carbohydrate (N-acetylglucosamine-6-O) sulfotransferase 2
  Uniprot ID: Q9Y4C5
  ENST ID: ENST00000309575
  CDS Start-End: 1385-2977
cgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgtttccctgcagggggcagcgcgggacatgctgagcgctctttaccgctgcgacctctctgtcttccagttgtatagccccgcgggcagcggggggcgcaacctcaccacgctgggcatcttcggcgcagccaccaacaaggtggtgtgctcgtcaccactctgccccgcctaccgcaaggaggtcgtggggttggtggacgaccgcgtgtgcaagaagtgcccgccacagcgcctggcgcgtttcgaggaggagtgccgcaagtaccgcacactagtcataaagggtgtgcgcgtcttcgacgtggcggtcttggcgccactgctgcgagacccggccctggacctcaaggtcatccacttggtgcgtgatccccgcgcggtggcgagttcacggatccgctcgcgccacggcctcatccgtgagagcctacaggtggtgcgcagccgagacccgcgagctcaccgcatgcccttcttggaggccgcgggccacaagcttggcgccaagaaggagggcgtgggcggccccgcagactaccacgctctgggcgctatggaggtcatctgcaatagtatggctaagacgctgcagacagccctgcagccccctgactggctgcagggccactacctggtggtgcggtacgaggacctggtgggagaccccgtcaagacactacggagagtgtacgattttgtgggactgttggtgagccccgaaatggagcagtttgccctgaacatgaccagtggctcgggctcctcctccaagcctttcgtggtatctgcacgcaatgccacgcaggccgccaatgcctggcggaccgccctcaccttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaatatttgcctccattactttggattcacctgtgttacttgtcctcagcttcagatagaatctccttcccctccctcgtttccatttttccagtctctttcctgaaaggcagctaaactgggtgggagcaatttttgcctccttggtaataacctgggggatgttttctcacatgtaaatctcagcctgttaggtgtccaggagtgaaacacatctttgtattctaaaggcagaaaccaaacagggcagtggaagaaaaagcacactactctcttcaactttgaacacaggaagaagcaactccttcaggacttgaaggcatttggtttttcattcctcttcagttaaaatggggaaccttgaagcagagaccaatgttttggtgctgaggctggttcagaaaaaggatttttaaaaaaagtatgtaatttttaaaagttctgatgattagaacacagacctcaggaaagtagcgtgaacatactgctggcgatggtagcagcttcgttggtttagcaaagtgacagaagtatctatttggagtgtttttctgaccctgacacggtatgtggaggtggatgaaagcagcgaagtttcatctgagaaccgtaagggttttcccttttcttacttgcttcccatttaaatcagtgcaagagagaatatgaatttataatgctttacttgggatgcctgtggaatatgttgcttttctttatcatgtttcctaaaagtaaatttgcaaagaaagtaacatgctgcagacagtataaggcttcagccaagagcttcttttagatatgataatgaattgtggtaaagaggaaatgaaaatgaactagtgtgtaggattttgaaatttggtattttccagggagaaaaccgttacattttcctgtagtggttatgatgttgtgtcctgaacccatttggtactgaaacattctgcagaatgttatactatgagaagaaattgtgaagcccaaatgggaacaagagacagtgtagttgtatatgacagtaaatacagtacaagttcactatca

SEQ ID NO: 114138 - DNA, 2659 bp, Homo sapiens
  Payload ID: 2308
  Gene Symbol: CARKD
  Gene Name: carbohydrate kinase domain containing
  Uniprot ID: Q8IW45
  ENST ID: ENST00000309957
  CDS Start-End: 15-1187
catttggcccggggatggtcacacgcgcgggggccggaactgccgtcgccggcgcggtcgttgtcgcattgctctcggccgcactcgcgctgtacgggccgccactggacgcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaattt

SEQ ID NO: 114139 - DNA, 2311 bp, Homo sapiens
  Payload ID: 2308
  Gene Symbol: CARKD
  Gene Name: carbohydrate kinase domain containing
  Uniprot ID: Q8IW45
  ENST ID: ENST00000424185
  CDS Start-End: 133-846
atctagaaccgggtgtgattgagcgagttgggatcccactgccgacagccgcgcggaggcggtcgggaaaccggaaaacgcttccaatggctgtgtttccggcgacggcgcgggggcagctgggaatccggaatgctgcccgatggccctgggtcctcgctgtggggcaatccgggcttgcagacgagtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaattt

SEQ ID NO: 114140 - DNA, 2842 bp, Homo sapiens
  Payload ID: 2309
  Gene Symbol: CHST10
  Gene Name: carbohydrate sulfotransferase 10
  Uniprot ID: O43529
  ENST ID: ENST00000264249
  CDS Start-End: 387-1457
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgccaaacctga

SEQ ID NO: 114141 - DNA, 604 bp, Homo sapiens
  Payload ID: 2309
  Gene Symbol: CHST10
  Gene Name: carbohydrate sulfotransferase 10
  ENST ID: ENST00000409046
  CDS Start-End: 181-604
tgggcccctctccccgccgcggggcgcacggaaaaaccggggaacccgcgggttttgtcctggcgagccacatcccgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaa

SEQ ID NO: 114142 - DNA, 1338 bp, Homo sapiens
  Payload ID: 2309
  Gene Symbol: CHST10
  Gene Name: carbohydrate sulfotransferase 10
  Uniprot ID: O43529
  ENST ID: ENST00000409701
  CDS Start-End: 268-1338
aagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaa

SEQ ID NO: 114143 - DNA, 585 bp, Homo sapiens
  Payload ID: 2309
  Gene Symbol: CHST10
  Gene Name: carbohydrate sulfotransferase 10
  ENST ID: ENST00000448989
  CDS Start-End: 159-585
atgcaataagaaggcgtccttgtgcgggatgctgtgacccgcggaattattgatattgtgcgagcctacaatttacttctttcatccttggctgagaatttgcgtttgtaattgtagatggagagaggaagaaagggttcagcttgggtccaaggagcatgcagaggaaggcagggaagaaggagcatgtgcagcttcgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatg

SEQ ID NO: 114144 - DNA, 673 bp, Homo sapiens
  Payload ID: 2309
  Gene Symbol: CHST10
  Gene Name: carbohydrate sulfotransferase 10
  ENST ID: ENST00000435960
  CDS Start-End: 574-673
agtagggtgagctcggggacgcgcaggcgggtgggtttcagcgcctgggcccctctccccgccgcggggcgcacggaaaaaccggggaacccgcgggttttgtcctggcgagccacatcccgatggagagaggaagaaagggttcagcttgggtccaaggagcatgcagaggaaggcagggaagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaaggtgaaccaggttttccaaaatgtcatttttgctttccaagtctgcaaggcaggaaagggttgggcagtgaatggaaagtagtgcagccaggttctggttagctcagcggcaggactgtcataacgtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatg

SEQ ID NO: 114145 - DNA, 574 bp, Homo sapiens
  Payload ID: 2309
  Gene Symbol: CHST10
  Gene Name: carbohydrate sulfotransferase 10
  ENST ID: ENST00000420858
  CDS Start-End: 176-574
actatctaggtttatgtaagaacgctctgatgtttgcagaagaacatcgcctaacgatacatttctcagaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccag

SEQ ID NO: 114146 - DNA, 559 bp, Homo sapiens
  Payload ID: 2309
  Gene Symbol: CHST10
  Gene Name: carbohydrate sulfotransferase 10
  ENST ID: ENST00000421474
  CDS Start-End: 305-559
agcgcctgggcccctctccccgccgcggggcgcacggaaaaaccggggaacccgcgggttttgtcctggcgagccacatcccgtgacaagaggaaccaagaacctcagttcaggggaaacacagcaaggaaatgtgagccccaggctgcagaagaccctactgtcgcattaatttctggcaaccacactgagaaaggtgtagattaagctggaaaatcacgaagagtgccaagggattggtcagtttttactgggggtctgcaccaggccaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctg

SEQ ID NO: 114147 - DNA, 692 bp, Homo sapiens
  Payload ID: 2309
  Gene Symbol: CHST10
  Gene Name: carbohydrate sulfotransferase 10
  ENST ID: ENST00000418201
  CDS Start-End: 501-692
gggtgggtttcagcgcctgggcccctctccccgccgcggggcgcacggaaaaaccggggaacccgcgggttttgtcctggcgagccacatcccgtgactgggttaaaatgaaaagacacaaagagagaagtggtcttttcccttccctccccattataattaagagcttagtccatcttggctcagaattggaattcagaattcagaattgctcttgaccctgaagaatagaatctcaaagaaatacctgagcagaaaattctcttcttcgctgaaatgaaaattggagtgtttgcaaaactgaacaaagaaaggaaagaatttgtaaacatcacaggcaacttgcagttatattcggatcatttttcagtgtttgaggagttcatacaataaaaagtgacaagaggaaccaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaag

SEQ ID NO: 114148 - DNA, 1232 bp, Homo sapiens
  Payload ID: 2310
  Gene Symbol: CA1
  Gene Name: carbonic anhydrase I
  Uniprot ID: P00915
  ENST ID: ENST00000431316
  CDS Start-End: 116-901
ctcctccctattctagaaatagaagggaggaggacctattttgttccatcctgtaggctgatcctttacacctaggactggaagaaataagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttc

SEQ ID NO: 114149 - DNA, 551 bp, Homo sapiens
  Payload ID: 2310
  Gene Symbol: CA1
  Gene Name: carbonic anhydrase I
  ENST ID: ENST00000522389
  CDS Start-End: 47-430
aaaaagaaaactcagtagaagataatggcaagtccagactggggatatgatgacaaaaatgcttcacgtagctcactggaattctgcaaagtactccagccttgctgaagctgcctcaaaggctgatggtttggcagttattggtgttttgatgaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttca

SEQ ID NO: 114150 - DNA, 614 bp, Homo sapiens
  Payload ID: 2310
  Gene Symbol: CA1
  Gene Name: carbonic anhydrase I
  ENST ID: ENST00000522579
  CDS Start-End: 168-614
gtggtacccagtcctcaggtgcaaccccctgcgtggtcctctgtggcagccttctctcattcagagctaaatagaagggaggaggacctattttgttccatcctgtaggctgatcctttacacctaggactggaagaaataagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatg

SEQ ID NO: 114151 - DNA, 675 bp, Homo sapiens
  Payload ID: 2310
  Gene Symbol: CA1
  Gene Name: carbonic anhydrase I
  ENST ID: ENST00000524324
  CDS Start-End: 93-675
gtggtacccagtcctcaggtgcaaccccctgcgtggtcctctgtggcagccttctctcattcagagctaaaaagaaaactcagtagaagataatggcaagtccagactggggatatgatgacaaaaatgtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcat

SEQ ID NO: 114152 - DNA, 606 bp, Homo sapiens
  Payload ID: 2310
  Gene Symbol: CA1
  Gene Name: carbonic anhydrase I
  ENST ID: ENST00000521679
  CDS Start-End: 1-535
gcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagcacaacaaccgcccaacccaacctctgaagggcagaacagtgagagcttcattttgatgattctgagaagaaacttgtccttcctcaagaacacagccctgcttctgacataatccagtaaaataata

SEQ ID NO: 114153 - DNA, 491 bp, Homo sapiens
  Payload ID: 2310
  Gene Symbol: CA1
  Gene Name: carbonic anhydrase I
  ENST ID: ENST00000519129
  CDS Start-End: 425-491
gtggtacccagtcctcaggtgcaaccccctgcgtggtcctctgtggcagccttctctcattcagagctgttttccacagaggtagtgaaaagaactggattttcaagttcactttgcaagagaaatagaagggaggaggacctattttgttccatcctgtaggctgatcctttacacctaggactggaagaaataagaaacagagtatcactatgtggcccaagctggtctggacctcctaggtgcaagagatcctcccacctcagcctaaaacacagattttaatgcccaattttgttataataagaattaaataagttaatgggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatccca

SEQ ID NO: 114154 - DNA, 1208 bp, Homo sapiens
  Payload ID: 2310
  Gene Symbol: CA1
  Gene Name: carbonic anhydrase I
  Uniprot ID: P00915
  ENST ID: ENST00000523022
  CDS Start-End: 93-878
gtggtacccagtcctcaggtgcaaccccctgcgtggtcctctgtggcagccttctctcattcagagctaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctcttt

SEQ ID NO: 114155 - DNA, 696 bp, Homo sapiens
  Payload ID: 2310
  Gene Symbol: CA1
  Gene Name: carbonic anhydrase I
  ENST ID: ENST00000517590
  CDS Start-End: 170-696
gtggtacccagtcctcaggtgcaaccccctgcgtggtcctctgtggcagccttctctcattcagagctgggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagcccc

SEQ ID NO: 114156 - DNA, 501 bp, Homo sapiens
  Payload ID: 2310
  Gene Symbol: CA1
  Gene Name: carbonic anhydrase I
  ENST ID: ENST00000522662
  CDS Start-End: 148-501
gtggtacccagtcctcaggtgcaaccccctgcgtggtcctctgtggcagccttctctcattcagagctatatgtgtacttcctgataagcagagatgatgaaataatggcctattaaaagcaaaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgag

SEQ ID NO: 114157 - DNA, 666 bp, Homo sapiens
  Payload ID: 2310
  Gene Symbol: CA1
  Gene Name: carbonic anhydrase I
  ENST ID: ENST00000521846
  CDS Start-End: 219-666
acccagtcctcaggtgcaaccccctgcgtggtcctctgtggcagccttctctcattcagagctgttttccacagaggtagtgaaaagaactggattttcaagttcactttgcaagaggggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatga

SEQ ID NO: 114158 - DNA, 527 bp, Homo sapiens
  Payload ID: 2310
  Gene Symbol: CA1
  Gene Name: carbonic anhydrase I
  ENST ID: ENST00000519991
  CDS Start-End: 115-527
gtggtacccagtcctcaggtgcaaccccctgcgtggtcctctgtggcagccttctctcattcagagctaaaaagaaaactcagtagaagataatggcaagtccagactggggatatgatgacaaaaatgcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacc

SEQ ID NO: 114159 - DNA, 454 bp, Homo sapiens
  Payload ID: 2310
  Gene Symbol: CA1
  Gene Name: carbonic anhydrase I
  ENST ID: ENST00000520663
  CDS Start-End: 192-454
gtggtacccagtcctcaggtgcaaccccctgcgtggtcctctgtggcagccttctctcattcagagctgggttgcagcagctcagacaatccttaccatgtgaaaggaggaatgactgtcatggcatgaaaaaagcatcactatgaaaaagaaaactcagtagaagataatggcaagtccagactggggatatgatgacaaaaatgcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactca

SEQ ID NO: 114160 - DNA, 2785 bp, Homo sapiens
  Payload ID: 2310
  Gene Symbol: CA1
  Gene Name: carbonic anhydrase I
  Uniprot ID: P00915
  ENST ID: ENST00000523953
  CDS Start-End: 1048-1833
ctttagcccaacagtcaaaaataattgatgctaccctacaaatgtccaaaactctagtatatcatatttctaagttacagcaaatattagtcctgctaaaccagggagctttggcaaaaatgttttttgacagtaaatttgtccttgattatatattaactagtcaaagaggtgtttgtaacattattagagcttcttgttgtaggtgggttaacaccaccaatcaagaggtcattctaacagaaagcctggatcagaaaaccatcaccctaaaaaaacatgccttacatatttaacacactctgaaatccagtcaaaatatgactaaaggcccttgccatgactgatgtattctcctggccaacgccaaacaaatgggagcctggttacgagtcagccttcagggacttgtcacatttctacttggtttcttccttgttattgtcataataaaatgttttctatgctgtttagtgcaacttaggccctattctgtagaagtctcctctactattcaggccactcaaacaccccaaataattgagttcaaaatcgacatcaagatataaaggaatcagtgactaaatatatttcatatatggtatttttattgattattgtgctgtcttgacctagtatggaggccttggctagaggctggtcagtttcctctcttgagcagctgattaaatccacaccccaaccacttcccttatcaggttctcacactctggggccactatgtacccactctaatcaccacagggccagacatcagacaattaaggacagcgcccatgccccaaagcccgccaaaattatgcaaattattcaaaattattcaacctagctaaccccaccctttttgctgtacataagctgcccattccccctccagcctgtggtacccagtcctcaggtgcaaccccctgcgtggtcctctgtggcagccttctctcattcagagctgttttccacagaggtagtgaaaagaactggattttcaagttcactttgcaagagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttctttctgttgtgcattcagtttctaaaaccattaagtttctactccatttacattcaaaaatcttaaatactttacttgcaagagtattttgcttcaaatacaacaacctaagagcagctggagatgaaatattgggaaattcatttgcttactcctgaagacaaaaatatagctgagatgaccactggatttaatatcgttatgctggcccaacattgctaccatttgtgttgtctgtgatcaaaatgattatcttttatataggaagatgacgcttctggatattgctttcacttcttctccccacgttagcaaggacaatgcttctctgccattattacaactagttagtttgcatggagaatctttactttaaaattggaagaaaagtcacaagtgaatggtttataaaaatgctaaagaagtcattcttgcttagaatcatatagaaacatcatgcaatcttttagtcagatgtgcgcttcaccttatgctatttttatctttaattgacacacaataattgtacatgtttatggagtatagtgtggtgttttctgtttgtttgtttgttttttgagacaaggtctcactctgccagtcagggtggagtgcgatggt

SEQ ID NO: 114161 - DNA, 652 bp, Homo sapiens
  Payload ID: 2310
  Gene Symbol: CA1
  Gene Name: carbonic anhydrase I
  ENST ID: ENST00000517429
  CDS Start-End: 93-338
gtggtacccagtcctcaggtgcaaccccctgcgtggtcctctgtggcagccttctctcattcagagctaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagcattgctgtaatctagtgaggcatcttggacttctggaaaacgcccaggtgtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaac

SEQ ID NO: 114162 - DNA, 618 bp, Homo sapiens
  Payload ID: 2310
  Gene Symbol: CA1
  Gene Name: carbonic anhydrase I
  ENST ID: ENST00000522814
  CDS Start-End: 174-618
gtggtacccagtcctcaggtgcaaccccctgcgtggtcctctgtggcagccttctctcattcagagctaattttttacaacaccttttttttagatatgtgtacttcctgataagcagagatgatgaaataatggcctattaaaagcaaaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttga

SEQ ID NO: 114163 - DNA, 832 bp, Homo sapiens
  Payload ID: 2310
  Gene Symbol: CA1
  Gene Name: carbonic anhydrase I
  ENST ID: ENST00000517618
  CDS Start-End: 80-832
atctcctgcatgcacagttgcagttagttattccaggtattatttttgttttcagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacct

SEQ ID NO: 114164 - DNA, 518 bp, Homo sapiens
  Payload ID: 2310
  Gene Symbol: CA1
  Gene Name: carbonic anhydrase I
  ENST ID: ENST00000523858
  CDS Start-End: 222-518
gtggtacccagtcctcaggtgcaaccccctgcgtggtcctctgtggcagccttctctcattcagagctgttttccacagaggtagtgaaaagaactggattttcaagttcactttgcaagagaaatagaagggaggaggacctattttgttccatcctgtaggctgatcctttacacctaggactggaagaaataagaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggc

SEQ ID NO: 114165 - DNA, 1236 bp, Homo sapiens
  Payload ID: 2310
  Gene Symbol: CA1
  Gene Name: carbonic anhydrase I
  Uniprot ID: P00915
  ENST ID: ENST00000542576
  CDS Start-End: 120-905
atccctctcttctttcaggggttgcagcagctcagacaatccttaccatgtgaaaggaggaatgactgtcatggcatgaaaaaagcatcactatgaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgttttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttc

SEQ ID NO: 114166 - DNA, 2405 bp, Homo sapiens
  Payload ID: 2310
  Gene Symbol: CA1
  Gene Name: carbonic anhydrase I
  ENST ID: ENST00000626824
  CDS Start-End: 1070-1453
ctttagcccaacagtcaaaaataattgatgctaccctacaaatgtccaaaactctagtatatcatatttctaagttacagcaaatattagtcctgctaaaccagggagctttggcaaaaatgttttttgacagtaaatttgtccttgattatatattaactagtcaaagaggtgtttgtaacattattagagcttcttgttgtaggtgggttaacaccaccaatcaagaggtcattctaacagaaagcctggatcagaaaaccatcaccctaaaaaaacatgccttacatatttaacacactctgaaatccagtcaaaatatgactaaaggcccttgccatgactgatgtattctcctggccaacgccaaacaaatgggagcctggttacgagtcagccttcagggacttgtcacatttctacttggtttcttccttgttattgtcataataaaatgttttctatgctgtttagtgcaacttaggccctattctgtagaagtctcctctactattcaggccactcaaacaccccaaataattgagttcaaaatcgacatcaagatataaaggaatcagtgactaaatatatttcatatatggtatttttattgattattgtgctgtcttgacctagtatggaggccttggctagaggctggtcagtttcctctcttgagcagctgattaaatccacaccccaaccacttcccttatcaggttctcacactctggggccactatgtacccactctaatcaccacagggccagacatcagacaattaaggacagcgcccatgccccaaagcccgccaaaattatgcaaattattcaaaattattcaacctagctaaccccaccctttttgctgtacataagctgcccattccccctccagcctgtggtacccagtcctcaggtgcaaccccctgcgtggtcctctgtggcagccttctctcattcagagctgttttccacagaggtagtgaaaagaactggattttcaagttcactttgcaagagaaaaagaaaactcagtagaagataatggcaagtccagactggggatatgatgacaaaaatgcttcacgtagctcactggaattctgcaaagtactccagccttgctgaagctgcctcaaaggctgatggtttggcagttattggtgttttgatgaagggcaaacgagccccattcacaaattttgacccctctactctccttccttcatccctggatttctggacctaccctggctctctgactcatcctcctctttatgagagtgtaacttggatcatctgtaaggagagcatcagtgtcagctcagagcagctggcacaattccgcagccttctatcaaatgttgaaggtgataacgctgtccccatgcagcacaacaaccgcccaacccaacctctgaagggcagaacagtgagagcttcattttgatgattctgagaagaaacttgtccttcctcaagaacacagccctgcttctgacataatccagtaaaataataatttttaagaaataaatttatttcaatattagcaagacagcatgccttcaaatcaatctgtaaaactaagaaacttaaattttagttcttactgcttaattcaaataataattagtaagctagcaaatagtaatctgtaagcataagcttatgcttaaattcaagtttagtttgaggaattctttaaaattacaactaagtgatttgtatgtctatttttttcagtttatttgaaccaataaaataattttatctctttctttctgttgtgcattcagtttctaaaaccattaagtttctactccatttacattcaaaaatcttaaatactttacttgcaagagtattttgcttcaaatacaacaacctaagagcagctggagatgaaatattgggaaattcatttgcttactcctgaagacaaaaatatagctgagatgaccactggatttaatatcgttatgctggcccaacattgctaccatttgtgttgtctgtgatcaaaatgattatcttttatataggaagatgacgcttctggatattgctttcacttcttctccccacgttagcaaggacaatgcttctctgccattattacaactagttagtttgcatggagaatctttactttaaaattggaagaaaagtcacaagtgaatggtttataaaaatgctaaagaagtcattcttgcttagaatcatatagaaacatcatgcaatcttttagtcagatgtgcgcttcaccttatgctatttttatctttaattgacacacaataattgtacatgtttatggagtatagtgtggtgttttctgtttgtttgtttgttttttgagacaaggtctcactctgccagtcagggtggagtgcgatggt

SEQ ID NO: 114167 - DNA, 1717 bp, Homo sapiens
  Payload ID: 2311
  Gene Symbol: CA2
  Gene Name: carbonic anhydrase II
  Uniprot ID: P00918
  ENST ID: ENST00000285379
  CDS Start-End: 231-1013
cccggcccgccccgccccgagcgcggggagttcacctccgcccgtcaccacctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 114168 - DNA, 875 bp, Homo sapiens
  Payload ID: 2311
  Gene Symbol: CA2
  Gene Name: carbonic anhydrase II
  ENST ID: ENST00000520127
  CDS Start-End: 115-408
gggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagcttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttg

SEQ ID NO: 114169 - DNA, 691 bp, Homo sapiens
  Payload ID: 2311
  Gene Symbol: CA2
  Gene Name: carbonic anhydrase II
  ENST ID: ENST00000522742
  CDS Start-End: 69-374
gcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagaaaaaggaatcagtatgctcagaaagaaagatgtgaaaaacatccattctccagacaacgcatgtgaggaataaaaacagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgt

SEQ ID NO: 114170 - DNA, 1753 bp, Homo sapiens
  Payload ID: 2312
  Gene Symbol: CA3
  Gene Name: carbonic anhydrase III
  Uniprot ID: P07451
  ENST ID: ENST00000285381
  CDS Start-End: 84-866
acataaaagcgcgggctcgcggcgactctgcaccacgcaggggaagagaaagcaggagccgtccagcacggaggaaggcgaccatggccaaggagtggggctacgccagtcacaacggtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagcttcatttggttcactggaacccgaagtataacacttttaaagaagccctgaagcagcgcgatgggatcgctgtgattggcatttttctgaagataggacatgagaatggcgagttccagattttccttgatgcattggacaagattaagacaaagggcaaggaggcgcccttcacaaagtttgacccatcctgcctgttcccggcatgccgggactactggacctaccagggctcattcaccacgccgccctgcgaggaatgcattgtgtggctgctgctgaaggagcccatgaccgtgagctctgaccagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctccttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaaggagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaa

SEQ ID NO: 114171 - DNA, 571 bp, Homo sapiens
  Payload ID: 2312
  Gene Symbol: CA3
  Gene Name: carbonic anhydrase III
  ENST ID: ENST00000520921
  CDS Start-End: 513-571
agaggcatcacagcatctcccatgacaagaaaggaatgtggatacggagagacttggcaaccaccggcaggcacagcagcaccagctaaattgcagctcaccaacaggcagcagttacatccctagttgtgctggtgtgggtctggagccaatgagtaagccaagagcagaccctcacaccctgcaccctgccccacaaggagctacccaagagtccacaatcatggccacaccttcctgctcacagcaccaattgtttataagatttgaagacttttgatggtggacacttacaggagttgtgtcggggactgagtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactg

SEQ ID NO: 114172 - DNA, 1154 bp, Homo sapiens
  Payload ID: 2313
  Gene Symbol: CA4
  Gene Name: carbonic anhydrase IV
  Uniprot ID: P22748
  ENST ID: ENST00000300900
  CDS Start-End: 100-1038
ggctccgctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcacagcctcgatggggagcactttgccatggagatgcacatagtacatgagaaagagaaggggacatcgaggaatgtgaaagaggcccaggaccctgaagacgaaattgcggtgctggcctttctggtggaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttg

SEQ ID NO: 114173 - DNA, 702 bp, Homo sapiens
  Payload ID: 2313
  Gene Symbol: CA4
  Gene Name: carbonic anhydrase IV
  ENST ID: ENST00000587265
  CDS Start-End: 1-298
gtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacaggtgcacagggcctggggcagggcatgggctcccactgcctggctccccagaaattatccctctgtctgccctcagaggtccctcaggatacaggtggggagcccaggtaactgaagtccgttgttaatcatcgacattcactgaagacaggcaagaaaagcctgagctgttccatcaccagattgggggctagacaggaggcaggggaaggtggagtcattcagaaaatggtgctggggtttctatcatgaacgaggctctggggagacagcagtgagcccaaaggacccaaatccctacccttgcactgctttcattccaaaacagtggttctcaaagtgcggcccctggaccagtggagtcaacatcatcactgggggaatttgttagaaatgctaatcctcagagctactgaatcaggaactctgggggtggagcccaggcatctggggcccaacaagcccgccccccagctgatgctaacgcatgctcaagtttgagagccacagtcctgtagt

SEQ ID NO: 114174 - DNA, 677 bp, Homo sapiens
  Payload ID: 2313
  Gene Symbol: CA4
  Gene Name: carbonic anhydrase IV
  ENST ID: ENST00000590203
  CDS Start-End: 1-555
gtgaaagaggcccaggaccctgaagacgaaattgcggtgctggcctttctggtggagatcgggagaatgaactggccaccaccactggctccctgcagactttctcaagacccttccctccctttccaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttggagaaa

SEQ ID NO: 114175 - DNA, 565 bp, Homo sapiens
  Payload ID: 2313
  Gene Symbol: CA4
  Gene Name: carbonic anhydrase IV
  ENST ID: ENST00000591725
  CDS Start-End: 452-565
gctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagggttggacattggaaacctactaagcagctagaaagtagaaagagaaatgctttgcagttctggtgctttgtagctgtgtggtcttggagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcac

SEQ ID NO: 114176 - DNA, 941 bp, Homo sapiens
  Payload ID: 2313
  Gene Symbol: CA4
  Gene Name: carbonic anhydrase IV
  Uniprot ID: P22748
  ENST ID: ENST00000586876
  CDS Start-End: 94-414
gctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagctgctaaggtccctgggccatcagaagcgaatagaacaaacctaagacatcactctccatcaagaggcctgcatgactctttatttacatcatcttccaggaagaggaggaggagctgctttggggacacccacttcctctccttacgtaacaacacactgcatttgcacaagtgtccttggttgtaaagggttccacactcactttcttattcagggcttattacaagcctctcaggtagctatggtcatggtaccctgatcccttgtcaaagatgagcccactgaggctcagggtgactaccgttgtgccaggagttgctaagtggtggatcacagactccagttca

SEQ ID NO: 114177 - DNA, 1618 bp, Homo sapiens
  Payload ID: 2314
  Gene Symbol: CA9
  Gene Name: carbonic anhydrase IX
  Uniprot ID: Q16790
  ENST ID: ENST00000378357
  CDS Start-End: 105-1484
cagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaa

SEQ ID NO: 114178 - DNA, 1374 bp, Homo sapiens
  Payload ID: 2314
  Gene Symbol: CA9
  Gene Name: carbonic anhydrase IX
  ENST ID: ENST00000617161
  CDS Start-End: 43-1113
gcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagtcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 114179 - DNA, 7567 bp, Homo sapiens
  Payload ID: 2315
  Gene Symbol: CA5A
  Gene Name: carbonic anhydrase VA, mitochondrial
  Uniprot ID: P35218
  ENST ID: ENST00000309893
  CDS Start-End: 67-984
aaagtgagaacagacagcagggaacatcaccctcttcagactggagtcagtgggaacagacccaagatgttggggaggaacacttggaagacctcagctttctccttcttggttgagcagatgtgggcccctctctggagtcgttcgatgaggccagggcgatggtgttctcagcgttcctgtgcatggcaaaccagcaataacactttgcacccactctggacggtcccggtctccgtgccagggggcacccggcagtctcctattaacatccagtggagggacagcgtctatgacccccagctgaagccactcagggtctcctatgaagcggcatcctgcctgtacatctggaacactggctacctcttccaggtggaatttgacgatgccaccgaggcatcaggaattagtggtgggcccttggaaaaccactacagactgaagcaatttcacttccactggggagcagtgaacgaggggggctcagagcacacagtggacggccacgcgtaccccgcagagctgcatttagttcactggaattctgtgaaataccaaaattacaaggaagctgtcgtgggagagaatggtttggctgtgataggcgtgtttttaaagctcggggcccatcatcagacgctgcagaggctggtggacatcttgccggaaataaaacataaggacgcgcgggcggccatgcgccccttcgacccctccactctgctgcccacctgctgggattactggacctacgcgggctcgctcaccaccccgccgctgaccgagtcggtcacctggatcatccagaaggagcccgttgaagtggccccaagccagctctctgcatttcgtactctcctgttttctgcacttggtgaagaggagaagatgatggtgaacaactatcgcccacttcaacccttgatgaaccggaaggtctgggcgtccttccaggccactaatgagggcacaaggtcctagagacattaggtccacatgaatagcagaactgactttgaaggaaggaagcgttgtttcccaagtttcacaatgtgattgtacatgacttctgaaattaaaaagagagcatgaggttattgttttagtcgaagtacttttcagctgcaagtgaaagaaagatgtgtaagtaccgtggggaacataacgctgggatggaggggtgtgccatggcacccaacgcaagtgcagggtgcttagtttcactgtaacgaagtaccacaaacttggtggattaaaacaatggagattgattctcttacggttcagtgagccagaagcccgacaccaaggtgtcctcacggctgcttccttctgaggctctagggcaggatctttttccttgcctttccagcttctgcctcctccttgtaagaactggcggggtgcattgcctcatgcctttaatcccagcactttgggaggccgaggcgggcggatcacgaggtcaggagatcgagaccatcctggccaacacggtgaaaccccatctctataaaaaacacaaaaattagctgggtgtggtgctgcatgtctgtaatcccagctacttgggaggctgaggcagaagaattgcttgaacccgggaggcagaggttgcagtgagccaagatcacactattgcactccagcgtgggcaacaagagcaaaactctgtctcaaagtaaaaaggaattcttgtgaggccaggcaccgtggttcacgcctgtaatcccagcactttgggaggccaaggcaggcagatcacttgaggtcaggagtttgagaccagcctggccaacatggtgaaaccccgtctctaccaaaaatacaaccaaaaataatctggcaggataaaaccagaaaacatacacaatttgatgtcaagacctacttcaaaagctgtagtaggccaggtgcagtggctcatgcctgtaatcccagcactttgggaggccgaggcgggaagaccacctgaggtcagaagttcgacaccagcctgaccaacatggcgaaaccccgtctctgctaaaaatacaaaaatgagctaggtgtggtggctcatgcctgtaatcccagctactcaggagactgaggcaggagaatcgcttgaacccgggaggcagagcttgcagtgagccgagatcatgccactgcactccagccagggtgacagagcgagactccatctcaaaataaataaataaataaaaataaaaagctatattaattaagataatgtggtacctgtcagagaaggacaaatcaaccaatgaaaaagaatagcgtgtctagaaggttccacacatttgtgatccctgactcatgctgtagggaatggatgggctcttctgtgaatagttttggatcatttggatatctattgattgatctatctattgattgatcgatcaattcatcagtcgatccatggggtctcactatgttgcccaggttggtcctgaactcctgggctccaatagttctcctgccttgacctcccaaagtgctgggattacaggcattagccaccccaccgagccaacgggatatccaaatggggaaccatgaatcttttttctcaccatacctcacacccctacctcacagcacacacaaaaattaattcctgacagattatagatctaaacaggaaaggtaaaacaataaagctcctaaaaaataacaggagctgggcgctgtggctcacgcctgtaaacccagcactttcggaggccaagttccagactagcctgaccaacatggagaaaccccatctctactaaaaatacaaaattagccgagcttggtggtgcatgcctgtaatcccagctactcgggaggctgaggcaggagaattgcttgaacccgtgaggcggaggttgtagtgagccgagatcgcgccattgcattccagcctgggaaacaagagcgaaactttgtctcaaaaaaaaaaaaaaaaaaaaaaacttgatccagaactcaatgttgggtctgagtgtggcttttctgtctctctttcatgatgttgtctctctcggcaagctcattcttttggaggaaagagagctaccactcgtgccaggatggtttccattaattcatgtaacatttattgagtgccaattacgtggcaggctctattctagactctggggacggagcctagactgtttaaggtctgaagagcctttgcctcggagctcacattctgatggaaggaggtagaccatgatgcatccacacagaaagtctggagtggtaagtcacaggaagaggacatggctgggtggggaggtctcttctacaggggccatttgggcagagaccaaaggaggagtgaaccacgtggctacccaagggcagagaattccaggcagaggctggaggcaggagcgcccttctggtgttcaaggtgcagcccgagggtgagggcagccaagtgcaggggtgaggagagaggcatgggaggcaagggtgggtactggggccccacaggctgggtggagactttggagctgctgctgggttctgagcaaagggcattttcaagtggagaggctcagttcggctgtgctgccaaagagttttccaaagtggtcattcctgtccttgccagcaggtcattgtgtgctttctggagggtgtgcccaggtgtctcctgtggatttaatttgcacttccctaatgattcatgacgtggagcactttgtgcagattcattggccgtctgcatatcctctttcaccagatacctgcttgagccatttgcccatttttctcttgggctgtctgtggttttcttattgatttttaggagttctttatatattccaattataaggcctttgtccattttacaaatctcttctcccactctggggctgcctttcaccctcttttttttgttgttgttgttgttttgttttgttttgttttgttttgtttttgagatggagtcttgctttgtcacccaggctggagtgcagtggcgcaatcttggctcactgcaaccttcacctcccgggttcaggtgattctcctgcctcagcctcacaagtagctgggattacaggcatacaccaccgtgcctggctaattttgtatttttagtagagacggggtttctccatgttggtcaggctggtctcgatctcccgacctcaggtgatccgcctgcctcgtcctcccaaactgctgagattactggcatgagtcactgagtcgggtctggatcaagcttatagcaatggttgcacctgatcagttacacaagccaataggtgccctttcatgtaagccagtttgggtttctttttacctattacttgcttggaaaaaatccaaaatcagtacagtgtttttcttttccttttttttagatggagtgtagctctgttgcccaggctagagtgcaatgtcacgatctcagctcactgcaacctctgcctcccgggttcaaacaattctcctgcctcagcctccggagtagctgggattacaggtgcccgccaccacgcccagcgaatttttttttttttttttgagacagagttttgctcttgtcgcctaggctggagtgcattgatgcgatcttggttcaccacaacctctgcctcccaggttcaagtgattctcctgcctcagcctcccaattagctgagattacaggcatgggccaccacgcctggctaattttgtatttttacgagagacggggtttctccatgttggtcaggctggtctcaaactctcaacctcaggtgatctgcccgcctcagcctcccaaagtgctgggattacagacgcgagccactgtgcccagtcttttttttttttttttttttttttgcatttttagtagagattcggtttcaccatgttggtcaggctggtctcgaactcctgacctcaggtgatctgcctaccttggccccccaaagtgctgggattacaggcatgagccaccgcgcctggcccagtatttttattttcatagcattaaaaaatattcccgccagaagagagaaagttttacaataaacctaattacattatcttccaacattaccttacagtcagatgagcacagaaaaataagcagatgctaatctgtttcccaaggtgataaaggccatttcattccggggagataaagaataagtaggttaggtcaggcgcggtggctcacgcctgcaatcccagcactttgggaggctgaggtgggcagatcacctgaggtcaggagttcgagaccagcctgggcaaaacggtgaagccccgtctctactaaaaaaaaatgcaaaaaattcgctgggcgtggtggcaggcacctgtaatcccagctacttgggaggctgaggcaggagaattgcttgaacccaggatgcagacgttgcaatgagccaagattgtgccactgcactccagtctgggcaacagagcgagactccgcctccaaaaaaaaaaaaatacgaaaagtaggccgggtgcggtggctcacgcctgtaatcccagcactttggaaggctgaggcaggtagatcatgaggtcaggagatcaagaccatcctggctaacacggtgaaaccccgtctctactaaaaatacaaaaaactagccgggtgtgctggtgtgtacctgtagtcccagcgactcgggagactgaggcagggagaattgcttgaacccaggaggtggaggtttcagtgagccgagatcgtgccactgtactccagcctgggcaacagagtgagactccatctcaaaaagaaaaaaaaaaaaaaactaaggctaggcgcggtggctcacgcctgtaatcccagcactttggaaggctgaggtgggcagatcatgaggtcaggagtttgagacgagcctgggcaatattgtgaaaccctgtctcttctaaaaatacaaagaaaaatcagccgggcgtgttggcacgcacctataatcccagctactgtggaggctgaggcaggagaattgcttgaacctgggaggcagagcttgcagtgagccgagatggtggccaccgcactccagcctgggcgacagagcgagactccgtctcaaaacaaaacaaaacaaaatctagccagaaatcgcttgaacccaggaggtggaggtcgcagtgagctgagattgtgccactgccctctagcctgggcaacagagtgagactccacccctccacgcccccccaaaataaagcgtctggctctttaaaggagatcacacttggtggcgatgcgggtgaaagaggattgggttgaaggagtcgaagtggaagcgggaaagcaccaagcggggaaatgggcacgtttctgttctgctctaagctgctgcgcctgacttcgattccatcgatcaagaggagtctgctgaaggacagggtgtacggctgcctcgcccgctcctgaaccaggcccgggtgaagtgtgttgtgcacattcagcagctccagccccgctgtgggtcgcactgacatgttgggcccagcccacgccccagaagctcgcagcgccgttggtctggggaatggtgttttaggaaaaactcccgaagtgacaggatggtgtcgttgggcgtaagggccacggcactcccattgagttgcgacaagttccacaaaatcgtccctggtttttaataaggaaactgaggctcacttgagaagttaagaaagttgtcgctgacccgctaggccaagggatacgcagcatttcactcttgccttctctgatttgtgcaatcagtcaaggaaaaagcgcagcaaagagagaaagtcctgaaccttaaaacccaggagaaaacttatcctacaatgccgggcagttcacgctgatggaagcagcagccagaggaaggcacttgtctgggcttcctgcagcgctctgagaacagcccgctcctctgctggggaaggggtgacacagtcaatggagggggtggtctctgaacctggggcttgggatgggggcagagagcagctattcagccattctccatgggctgcccatttccaggtgggcttggggacagagaaaggcccaagcggccagaggggccctgggctccagttctaccggccccatgttgacatcgtgtccaacaagacaccaagagaagcagggagtggctgaccttcattttccgtatcaacacacagggggccctctgcacccaccaacatctttgtctcctgaaaaatggcctttgtcagttatttttaaaaactggtgctaatcctgagacacggagatactcccgggaagccatccgagcctggacacactgagatgaaaccacaaacacgccgagaggaaaagacattgattccagccctcaaagcaacgggacaaaaaacaaacaggaggcttccctcccgccccaggggcagcggccggtgtctgcggctctgcgggaagggctctcactgtgaccagattgtggcttctgattgtattgtagaatttctggcccagcttttaaggttcaaggcttcctccctttgcttttatcttattttcttgtttaataaagatacgcctgtgtgagaagca

SEQ ID NO: 114180 - DNA, 6835 bp, Homo sapiens
  Payload ID: 2316
  Gene Symbol: CA5B
  Gene Name: carbonic anhydrase VB, mitochondrial
  Uniprot ID: Q9Y2D0
  ENST ID: ENST00000318636
  CDS Start-End: 137-1090
gtagcttcgatggccggacgtgcaggctgcggatccccgtaggcgagcgagcggctaggttcgtgatctggagagacgctcagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgatcaagggaggacccctggaacacaactaccgattgaagcagttccattttcactggggggccatcgatgcctggggttctgagcacaccgtggacagcaaatgcttcccagcagagctgcacttagtgcattggaacgcagtcagatttgaaaactttgaggatgcagcactggaagaaaatggtttggctgtgataggagtatttttaaagctaggcaaacatcataaggagctacagaaattagtggatactttgccgtcaattaagcataaggacgcccttgtggaatttgggtcatttgacccttcctgcctgatgcctacctgcccagattactggacctactcagggtctctgactaccccacccctctccgagtctgtcacctggatcattaagaagcaaccagtagaggttgatcatgatcagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttcttagcatgagagtgcttcatcagtctttgaggaaggctattcggtaccagcaagagacacaagtttctcttacagatacctgttggtaattgtaatgccttttttttttctttaagagactaggtcttgctctgctgcccaggctagagtgcagtggccaaatgatagctcactgcagccttgaactcctaggctcaagcagtcctcctgccttagcctctagagtagctggggctacaggtgctggccgcctggcccagcttgtaatatctttttatgtctgacatttttgagctatctttttatgtttatccattagtggttctatagcactatacatagggattataatcaaaatttttaacatgtggtaaggcacagacactgaccagaactcaggccttgcagaaacagcctatgggcccagactggtacttcctggctgaatattggccatggttttagatgtattttattttataacatgaatgtgtattctttcataagggcttatcagtcagtatatttgccccagtgtttagttgttacaaggacatgatatgcttacttactatcagtttatgatgtagaaaatatattttgtaattataagaaaacaagacttttcctatacccagaaatccctttgcatttccgaagatcagatattttgcttaaaggtctgatcatataggaaatatatgcagaacattttaaagaaaatgcctggctgggcacagtggctcacacctgtaatcccagcactttgggaggctgaggcgggtagctcacttgaggtcaggagtttgagaccagcctggccaacatgatgaaaccctgtcactactacaaataaaaaattagccaggcatggtggtgagcacctgtaatgccagctactcgggaagctgaggctggagaatcgcttgaacccaggaggtggtggttgtagtgaaccaagatcacaccactgcactccagcctgggcaacagagtgagactctgtgtctaataaaaaaaaaaaaagaaaagaaaagaaaaaatgcttaaagtgcctagaacttagaattctttcattgcacatttccagaaatatttttcttttcttttttttttttttttttgagatggagtctcgctctgtcccccaggctggagtgcagtggcactatcttggctcactgcaacctccacctcccgggtttaagcgattctcctgcctcagcctcctgagtaactgggactacaggcacatgccaccacgcccagctaatttttgtatttttagtagagatggggtttcactatgttggccaggctggtcttgaactcctgacctcaggtgatccacccgccttggcctcccaaagtgctgggattacaggcgtgagccaccgtgcccggccttccagaaatatttttcaaaggactagtaatctaatagcctatagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtttctgaatgcctctaagcctatgttcagactctgttgcgtcaatgactggtagtatttctttcattaatatgtttgtcatctggtctgcaagatagggttggatgaatatacttaacactactgaactgtacacttaaagatcgttaggaaggaaacgggactacatcaaacttaaaaatgtctgtgtgtcaaaggaagcaatcaacaaagtgaaaacgcaagctctagaatgagagaaaataattgcaaatcgtctatcttataaggagcccaaatccagaatatatgaggaacttctacaactcaacaacaaaaaaccaaataactcaatttttaaaaatgggcaaaggacttgcacagacatttctccaaagaagttatacaattggccaataagaacatgaaaatatgctcaacattgccaattattagggaaatgcaaatcaaaaccacaatgagatatcgtctcacgcccatcatgatggccactatcagaagaacaaaaaaataacaagtattggggaggatgcagagaagttgaaacccttgtgcactgttggtggtaatgtaaaacggtgcagtcattacggaaaacagtacacaggtttcccaaataactgaaaacagaattaccataagaattaccaccaaagcgggatctcaaagagatatttgtacacccatgttcatagcagcattattcacaatagccaagaggttctggaagcatcccaaatgtccatcaacagatgaatagataaaggaaatgtggtatatacagtcaatggaatattattcagcctttaaaaagaaggaaatcctgtcaaatgtacaatgtggatgaaccttgaaggcattatgccaagtgaaataagccagccaacaaaagaacaaatgctatatgattcctccatgtgaagtatgcaaagtagtcaaaatcatacaatagaaagtagaaaggtggttgccaagcaacggttgggggaaggggagagggtgaatttgtatttagtgggtacagagcttgtgttgcaagaattctagagatctgttgcaaaacaagtgtgattgtacttaacactactgaactgtatacgtataagtttgagaaatatctcttttaaaaagggggaaatgtgaaggcttttgcatgtatgccctaggaaatgcatagaattcttagaaaggtaaacatggtaaaaaaagaagtctttgttaactttctgcagttcacctgtttcaaagtatagttacctttaaaagggtaaacacacaagatatgcattttccaaagcatacaggctttcctcctagctgtcttgttttttatttttttttattttttttatttttttgagacagagtcgcgctgtcacccgggctggagtgcagtggcgcgatctcggctcactgcaagctccgcctcccgggttcacgccattctcctgcctcagcctcctgagtagctgggactacaggcgcccgccaccacacccggctattttttgtattttaagtagagacagggtttcaccgtgttaaccaggatggtctcgatctgacctcgtgatccacccgtcttggcctcccaaagtgctgggattacaggtgtgagccactgtgcctggccttcctagctgtcttgtgaaacgataagtcaaaaccctactgcagtgagttttccaaactgaagggagaagcaatgtacagaatgcctgacttgcccttacatcttatacctggtgttctggcatgattattaaccacactctttttcactttgaaccatgtcctggtttgcatggccagcttccctgcagaggtgatagaaactgacttgaggcagtttctttctccatgccttagttagatgaccctcaaaggggcacagcagatttccctggctactgatacaccttaacaagaagcttgtgttttttatgccctcaaaagtgttttacttatactttcctagacataaaggtggaaaatgggcctaaggtctgtcaaaggtcttggaaaagaagattgtattaaaattgctgtccgtcttcattaaataatactagatcgatacaatgctttctttacagtattagtggttggtgaaagacttccttcctattgttacagtatatgtatatatctgtaaaattaatgagatatcctttaacttgtagattagaaagcgactaaaaactcataggggatttactaaagaagcaacaatgggaagaagcagccgatcctcctcagtgcacctttttctgttgcacagtacagtgcacagtgtgctggcatcaccatatagggcaagctgtgaccgcctttctcctttcccagggctacatggtgccaagcaggttcagtgtacactggttaccaacctgtctgattccattgtgacagaacacactcacacccaatacattacatgaagcagatttattacttacagacaggaagcaagggacaaaagaggccctggctccattgtgagccagtcccccagggctcaagaaagctgcccagggcggggctgatggagtcttgattgtacgtgccccacttgcaccacagcctgccttgggttatataccataggagccacataactcattgggcaaagctttaaagtacatcctccttccaggggaaagaggaacacaacctcgctgtctcaaacagttccctaaatcaagatgttacattccctaggagggacaacaacaaggccaacctgtttcaggcagttcctccatatcaggatattgcattcccagtgcattctacagttattcttaagaactacaagcaaggaagaagggagaactgggtcagtccaaggccacctggagaactgtcttgtacatgggttagggtaaagttggctattctaaaactaagcatccgcccaaaagaagtcttggaagatgtctttccctgttaaattcagatgatggtaattatagtttggaagtggaattggcttttagagttacttcctgtaatgaaattaacaagcaattcaggcctatttctgaaaatgaattcagtggttaattgttaaaaataaatgtctaactcctataaaaggaaatttacattcatttctaactcactaaaaaatctatggccgggtgcggtggctcatgcctgtaatcccagcattttgggaggccgaggcgggcagattaccggaggtcaagagttcgagaacagcctggccaatatggtgaaaccccgtctctactaaaaaatacaaaaattagccaggtggttgtggcatgcacctgtaatcccagctacgcaggaggctgaggcagaagaatcgcttgagcccaggaggcggaggttgcagtgagccgagatttcttagaaggaattgttacttattgttctgaagtgaaagtctggtctgattcagaagaaatgttacaacaacttaaacactgatgctttcagaacgggcagcaattctcagcgtaaattctgatcacagggaccagcaaaattggtgagttgcatagctacaacattctgtgccatccagggcactctagtttggggatacaactgccaaacctccaactagagagtttagtttaagatttagtcaagaagcagaaaggtaaaggtgacaatgtgtagtaaaccatgatagatgttataaaaggtggaatacttgtactggaaatgcatacagcgcctcatcccctcttgaggggtcaggaagttttcacactaatgatgatggtgatgagatgatgtaacagctaaagttttggaggcattcactattgctaggcactgtatcagcatataacatggcttatcttactcagttttcacaataaaagggttatgagatggg

SEQ ID NO: 114181 - DNA, 2205 bp, Homo sapiens
  Payload ID: 2316
  Gene Symbol: CA5B
  Gene Name: carbonic anhydrase VB, mitochondrial
  Uniprot ID: Q9Y2D0
  ENST ID: ENST00000454127
  CDS Start-End: 55-1008
gattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgatcaagggaggacccctggaacacaactaccgattgaagcagttccattttcactggggggccatcgatgcctggggttctgagcacaccgtggacagcaaatgcttcccagcagagctgcacttagtgcattggaacgcagtcagatttgaaaactttgaggatgcagcactggaagaaaatggtttggctgtgataggagtatttttaaagctaggcaaacatcataaggagctacagaaattagtggatactttgccgtcaattaagcataaggacgcccttgtggaatttgggtcatttgacccttcctgcctgatgcctacctgcccagattactggacctactcagggtctctgactaccccacccctctccgagtctgtcacctggatcattaagaagcaaccagtagaggttgatcatgatcagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttcttagcatgagagtgcttcatcagtctttgaggaaggctattcggtaccagcaagagacacaagtttctcttacagatacctgttggtaattgtaatgccttttttttttctttaagagactaggtcttgctctgctgcccaggctagagtgcagtggccaaatgatagctcactgcagccttgaactcctaggctcaagcagtcctcctgccttagcctctagagtagctggggctacaggtgctggccgcctggcccagcttgtaatatctttttatgtctgacatttttgagctatctttttatgtttatccattagtggttctatagcactatacatagggattataatcaaaatttttaacatgtggtaaggcacagacactgaccagaactcaggccttgcagaaacagcctatgggcccagactggtacttcctggctgaatattggccatggttttagatgtattttattttataacatgaatgtgtattctttcataagggcttatcagtcagtatatttgccccagtgtttagttgttacaaggacatgatatgcttacttactatcagtttatgatgtagaaaatatattttgtaattataagaaaacaagacttttcctatacccagaaatccctttgcatttccgaagatcagatattttgcttaaaggtctgatcatataggaaatatatgcagaacattttaaagaaaatgcctggccttccagaaatatttttcaaaggactagtaatctaatagcctatagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtt

SEQ ID NO: 114182 - DNA, 517 bp, Homo sapiens
  Payload ID: 2316
  Gene Symbol: CA5B
  Gene Name: carbonic anhydrase VB, mitochondrial
  ENST ID: ENST00000478341
  CDS Start-End: 1-212
gcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagagtgtgcccccttctcaactggaagtccataatattaccttgtttatacggattccagaaatcttcaaaacaacaagctaaattcctgtgttctggatgactgtctggcactctgtgactgcctcttatttcctgtttattctttgctgctatttctccatgttgttgcaaaacaatcaatagcatgcaaagaggaaaaaaagagtgaatgaacataaaaaataaaaagtgaaagaaagcaagacattttagaaacaaaggcaagaaacaattctagaaaagtaaaaacctaataaatatcgatgtctataaatttcaaagacaaaaccctaagaaa

SEQ ID NO: 114183 - DNA, 529 bp, Homo sapiens
  Payload ID: 2316
  Gene Symbol: CA5B
  Gene Name: carbonic anhydrase VB, mitochondrial
  ENST ID: ENST00000479740
  CDS Start-End: 122-529
agaggtttctccatcatcttaagtttctgttgtttacagctttccctcctctgccctcatccctctagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagtgatcaagggaggacccctggaacacaactaccgattgaagcagttccattttcactggggggccatc

SEQ ID NO: 114184 - DNA, 488 bp, Homo sapiens
  Payload ID: 2316
  Gene Symbol: CA5B
  Gene Name: carbonic anhydrase VB, mitochondrial
  ENST ID: ENST00000498004
  CDS Start-End: 259-488
ggaatttgaagattctacagataaatcagtggcactatcacaacagagtgacataatggtgggataacatggacacttgtcttcttccttactgtaatgggactatttctactccacataatctgcacagtgctcgacatgagataatcactcactgttccttcagttcaggactggaaatcaatggaaaggaagaacagttaagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagccttgcatccactctgggagagcgtggacctggttcctgggggcgatcgccagtcacccatcaacattcggtggagggacagtgtttatga

SEQ ID NO: 114185 - DNA, 942 bp, Homo sapiens
  Payload ID: 2317
  Gene Symbol: CA6
  Gene Name: carbonic anhydrase VI
  Uniprot ID: P23280
  ENST ID: ENST00000377436
  CDS Start-End: 1-942
atgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagtgcagatcagcctgccctccaccatgcgcatgacagtggctgacggcactgtatacatagcccagcagatgcactttcactggggaggtgcgtcctcggagatcagcggctctgagcacaccgtggacgggatcagacatgtgatcgagattcacattgttcactacaattctaaatacaagagctatgatatagcccaagatgcgccggatggtttggctgtactggcagccttcgttgaggtgaagaattaccctgaaaacacttattacagcaacttcatttctcatctggccaacatcaagtacccaggacaaagaacaaccctgactggccttgacgttcaggacatgctgcccaggaacctccagcactactacacctaccatggctcactcaccacgcctccctgcactgagaacgtccactggtttgtgctggcagattttgtcaagctctccaggacacaggtttggaagctggagaattccttactggatcaccgcaacaagaccatccacaacgattaccgcaggacccagcccctgaaccacagagtggtggaatccaacttcccgaatcagggcaagggccacggggggcatcgtgggagaagccaaaatccaagagtacagcccacctcaacacgccaccccttggctctgggcagcttagaagcctga

SEQ ID NO: 114186 - DNA, 747 bp, Homo sapiens
  Payload ID: 2317
  Gene Symbol: CA6
  Gene Name: carbonic anhydrase VI
  Uniprot ID: P23280
  ENST ID: ENST00000377442
  CDS Start-End: 1-747
atgagggccctggtgcttctgctgtccctgttcctgctgggtggccaggcccagcatgtgtctgactggacctactcagtgcagatcagcctgccctccaccatgcgcatgacagtggctgacggcactgtatacatagcccagcagatgcactttcactggggaggtgcgtcctcggagatcagcggctctgagcacaccgtggacgggatcagacatgtgatcgagattcacattgttcactacaattctaaatacaagagctatgatatagcccaagatgcgccggatggtttggctgtactggcagccttcgttgaggtgaagaattaccctgaaaacacttattacagcaacttcatttctcatctggccaacatcaagtacccaggacaaagaacaaccctgactggccttgacgttcaggacatgctgcccaggaacctccagcactactacacctaccatggctcactcaccacgcctccctgcactgagaacgtccactggtttgtgctggcagattttgtcaagctctccaggacacaggtttggaagctggagaattccttactggatcaccgcaacaagaccatccacaacgattaccgcaggacccagcccctgaaccacagagtggtggaatccaacttcccgaatcaggaatacactctaggctctgaattccagttttacctacataagattgaggaaattcttgactacttaagaagagcattgaactga

SEQ ID NO: 114187 - DNA, 1319 bp, Homo sapiens
  Payload ID: 2317
  Gene Symbol: CA6
  Gene Name: carbonic anhydrase VI
  Uniprot ID: P23280
  ENST ID: ENST00000377443
  CDS Start-End: 5-931
caccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagtgcagatcagcctgccctccaccatgcgcatgacagtggctgacggcactgtatacatagcccagcagatgcactttcactggggaggtgcgtcctcggagatcagcggctctgagcacaccgtggacgggatcagacatgtgatcgagattcacattgttcactacaattctaaatacaagagctatgatatagcccaagatgcgccggatggtttggctgtactggcagccttcgttgaggtgaagaattaccctgaaaacacttattacagcaacttcatttctcatctggccaacatcaagtacccaggacaaagaacaaccctgactggccttgacgttcaggacatgctgcccaggaacctccagcactactacacctaccatggctcactcaccacgcctccctgcactgagaacgtccactggtttgtgctggcagattttgtcaagctctccaggacacaggtttggaagctggagaattccttactggatcaccgcaacaagaccatccacaacgattaccgcaggacccagcccctgaaccacagagtggtggaatccaacttcccgaatcaggaatacactctaggctctgaattccagttttacctacataagattgaggaaattcttgactacttaagaagagcattgaactgaggaaagctaagaggaagattcaatattaactagcttgaagcctgacctagccagaagtgcctgtccgctgcagccgcaccctaccttgtctaagaaaccatgtgtgtctggaacacgctgctccccctggggcagctgttgggattctgattaaaagaggggaaacgatcatcctggacaggaagtgagatggcttcagttcatgagacgggatctgagttagacatcaccagtggaaattgattggaatagaaacttaaaggaaatggaaccctaactattctcccatcaaatcatatatgttgacctgtctgaattataaaccagcctgacctttcctttagcattagatgtaataaaataactttggaaatttgtcatttaaaaa

SEQ ID NO: 114188 - DNA, 1493 bp, Homo sapiens
  Payload ID: 2317
  Gene Symbol: CA6
  Gene Name: carbonic anhydrase VI
  ENST ID: ENST00000480186
  CDS Start-End: 6-545
gcaccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagattggcaggcggaactcttcctcccctccttgtcctctccttgtggagaaggggcgaagcacaaaggccaaaggcagtggctttgttcaccctccctggacagctggtgggaagcaatcattgatggaggatctctatgggcaacgcttgctgagtgcgggcttcgtgctgagggcccagaagagggaaggcatatggaagagaagagcccagcttcccaaggggcttgcagcggctcccgcctcccaatttccagaggaccctgtaccttcttcctttagggctctgctcaaatttctgtggtccggaagcctgttcctttggggttctcacctcacacgacagcatgtcggacattagagtggacccaaagttcacattaattatatatatattaaaaacaatttttttttttgagatggagtcttgctctgtcaccccggctggagtgcagtggtgcaatcttggctcactgaaacctccacttcccagattcaagcaattctcctgcctcagcttccctggtacctgggactacaggcatgtgccaccacgcccagctaatttttgtatttttagtagagatgcggttttgtcatactggccagtctggtctcgaactccttgcctcaagtgctctgcccaccttggcctcccaaagtgctaggattacaggcacgagccaccaaggctggccataattccatttttcgatgtaaagggtttttttctgagatggagtctcactctgtcacccaggctggaatgcagtggcatgatcttggctcactgcaacctctgcctcctagggtcaagcaattctcatgcctcagcctcctgagtagatgggactacaggcgcacaccaccacccccagctaatttttgtattttttgtagagatggggtttcagcatgttggcctggctggtctcgaactcctgacctcaagtgatccgcccaccttggcctcccaaagtgttgagattatatgcataagccaccgtgcccagcctgatataaagtattttgaaagatttttataatttagcttttgaagttatttggctattgccattggctacttttcagcaagctccaagcacattcaggaattctactgaagggggaaaaaaagctaatctacaaactttgaatctaatgagattttgatgaacactaagcttaacagtaaagttgacatgacgtattaaagatttgttaattttt

SEQ ID NO: 114189 - DNA, 582 bp, Homo sapiens
  Payload ID: 2317
  Gene Symbol: CA6
  Gene Name: carbonic anhydrase VI
  ENST ID: ENST00000549778
  CDS Start-End: 21-582
cattacagatgtgcagcaccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaagatcagcctgccctccaccatgcgcatgacagtggctgacggcactgtatacatagcccagcagatgcactttcactggggaggtgcgtcctcggagatcagcggctctgagcacaccgtggacgggatcagacatgtgatcgagattcacattgttcactacaattctaaatacaagagctatgatatagcccaagatgcgccggatggtttggctgtactggcagccttcgttgaggtgaagaattaccctgaaaacacttattacagcaacttcatttctcatctggccaacatcaagtacccaggacaaagaacaaccctgactggccttgacgttcaggacatgctgcccaggaacctccagcactactacacctaccatggctcactca

SEQ ID NO: 114190 - DNA, 1555 bp, Homo sapiens
  Payload ID: 2318
  Gene Symbol: CA7
  Gene Name: carbonic anhydrase VII
  Uniprot ID: P43166
  ENST ID: ENST00000338437
  CDS Start-End: 110-904
ccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaata

SEQ ID NO: 114191 - DNA, 1713 bp, Homo sapiens
  Payload ID: 2318
  Gene Symbol: CA7
  Gene Name: carbonic anhydrase VII
  Uniprot ID: P43166
  ENST ID: ENST00000394069
  CDS Start-End: 432-1058
cggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaa

SEQ ID NO: 114192 - DNA, 1161 bp, Homo sapiens
  Payload ID: 2318
  Gene Symbol: CA7
  Gene Name: carbonic anhydrase VII
  ENST ID: ENST00000548332
  CDS Start-End: 432-566
cggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtcc

SEQ ID NO: 114193 - DNA, 3812 bp, Homo sapiens
  Payload ID: 2319
  Gene Symbol: CA8
  Gene Name: carbonic anhydrase VIII
  Uniprot ID: P35219
  ENST ID: ENST00000317995
  CDS Start-End: 266-1138
cgctcgctccccaggccacagccgctccctcgctctgctggggcctccggacgcgcttcccacgcgggtctctggaacactcggtccgaacgcacgcctgcttgcactcacactgcggttcacacccggaggcgctctcgcactcacactgccgctcacgcgtgctcacactcccccacgcgcgctccgctccggctccagccccgcgcccagcgaaggcgcaggcactgctgccgagagcgccgaggggccccgcggccttcccatggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacataccattcaggttatcctgaagtcaaaatcagttctttcgggaggaccattgcctcaagggcatgaatttgaactgtacgaagtgagatttcactggggaagagaaaaccagcgtggttctgagcacacggttaatttcaaagcttttcccatggagctccatctgatccactggaactccactctgtttggcagcattgatgaggctgtggggaagccgcacggaatcgccatcattgctctgtttgttcagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacagatagaagaatttcgaaggctgaggacacatgttaagggggcagaacttgtggaaggctgtgatgggattttgggagacaactttcggcccactcagcctcttagtgacagagtcattagagctgcatttcagtagccaaagaggacaggaacaagtctgtcttcatgagggaggaagacaatggtcctataatgcccttggataagaaaaggaaacttttgagctgcaccttcagtttatcctcaaagcctgcgttgtttgtcttcatctaatccagctttgatggacatctgtgatggttgcctgtacacttgctgaaatgaaatattagaaatggctgtatattccaaagaaaccctatattatatatccacattactgctgctaggattcatagttgcacatactgtttattgcttatgtgtagaaggaatgaaactagtttccagagttgttattaatatgaatatatatcatgtgttaatattgagaaaggaaaaatacattcccggtgttagtagttcttcatttcctgtctccaacagaaaattcactcattttagaactagtgtaattcttgataataaaataagagttttgattaagaacagcatagagcttcaaaatgcaaagtgaatgattagtaaaattatgtctcattttattttttcagcacccataccacaattaatattaggctggattgccatgggaaacattttttggcattaatgcagcaacataatactcactttaggtattactacatagttgaaggatttaactgaatgtatggatcaaatttatttatttgacatattcgaagctgtggtttaataggaatttgagaaaggtgtaagaaataggataaaaagaaggtcagcaccatgtaccaggaatagctttactttccatacatagaaatataaatttagtggtatcctatattactttagtgtcgtacgctttgtaagacttaaatattttattctattgattccactactttggtatgttaagacatttctttaaagatgaccaacaatatccttattttaggtgccactagcagatgtaagcgtatacttagttgccgttagatgtgacagaatgagataatttatgtaaagcagtagagtacctggcacaaagcaaacaataaatattattgttattgttgttataattgtaaaatgaatgacttcaaaaacatagtcccagtttggagggattttgtgatgcagaatatctaagtcatagaaatagaagacaggtggaataagtatatgttcagagtttttagatgtgttgagtagagacggtaataatggaagcattaaatacaaatgaaaatcacaccagatatccctgaaattcaagcaaagaaagttcatcatgtattcttgggcagcaagagaaaggactagggttatggcaatgtgtggaaaagttgaggcttgctaagggttgagatctgttggtagccctggatcacatggggtcagcaccaggcagtgcctctgaaagcggagagaggtcctggacttcccttgtgtataacagttcctagtgtccaacaatgaggaaacggtgaagcatggttacaaaactgtgacaaaaatatttacatctagcactgttaccactcacatgccaaacattggctgcacacgtgcagccttatttgtaattaacatcaaaagactagatctgaagccttccataaatgagaggccattcatatggcattcctggaacaaaacactgcacaggtaccagcctctccactcctgaccgggttggtgctgaacagtcagggattgttcttgaactagacttctgatgcttcttgcaatcttctttcatctttccctgaaatacacaaaataaacaaatacaataacaaatagtaattaaatgactttcaggataacatctagttgttcagacttcacccttcacaggtgtgtgtgtatgtgtgtttatgtctgtatattgaagcaatttgaatttatttactgtatattttctgagtaaaagactgaaatgaactacttggttcagatcatggtgtccattggtgacattgtttggaggcataatattctttatatggaaaatcctttaattccacagttagttacctcagattcagaatatgaatactgtttataatacgcttttgtaggaatgaatttgaaaggtagtttgtcagtaaacgaaagcacaacaactaatctcaaatctgttttgatggtgtgataggaaagaaagtaaaacctatgtgatggaccctgtaattggggcaggaatctcccaaagaaaaaggggagaattaatgacaaatgtcatagatcttgaaatttaatttagggtgcattttgtttatgaaacaatttaataaggcaacaaagtgaaatgatttttcatgtagcttatacacatgtaagtgcctctgattcatggtaactaacgtacctgatggtgtgtaaagtaatactgttgtcagaaggtttgccaattaagataatttgagtttactctttttttgttggttagtttagctgaaggcttgtcaattttattgatttttttcaaggagccaaagtggattttggggttttctctattgtgtttgtattctctatgtcatcaaactctgctcaaatcttacaaaatagtaagattagtaagaaagcagactaacttctgcttgctttgtatttagtttgtgtcttttccagtattttaaggtggaaggttaggttattgatttgaattcttttttgaataaaggcattaacagtta

SEQ ID NO: 114194 - DNA, 2914 bp, Homo sapiens
  Payload ID: 2320
  Gene Symbol: CA10
  Gene Name: carbonic anhydrase X
  Uniprot ID: Q9NS85
  ENST ID: ENST00000285273
  CDS Start-End: 1113-2099
ttcaattcccctgcatccacactgcaaccgggtgcaagtctttcctaggttatagacagcccgcctccccacgagaccttctgcggactggctgcccctggcctcggcctgggtgggtgggtggtgctcgcgccgcccctactttcccctggggccctggagagccgcgcgctgggtgtgtgtgtgtgtgcgcgcgcgggtttggtggggaaatctccttcagtggaagctgctgagtgtcgttggcggaaagtatcctggagcccagcaaaagcctccaaagcactagagcttccctaaagaaaagcagaataaaagaaagacaagaagggaagcccgttcctctaaagcccgggtttccaatagtcccggatcctcctggagttgggcgaaggcgcagttggcagcagccgctgctggcacccggacttggaaaggcggtgttcccccttttcgggaggagggaggcagggacttgcaggcaagagttgcacctggtctaggaacctgcagagaaaagaactctggggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttc

SEQ ID NO: 114195 - DNA, 2935 bp, Homo sapiens
  Payload ID: 2320
  Gene Symbol: CA10
  Gene Name: carbonic anhydrase X
  Uniprot ID: Q9NS85
  ENST ID: ENST00000442502
  CDS Start-End: 678-1664
acagttcccaatcgggacaagcgcgccgagaaatcctggatcttcccagggattccctctacgctccctcctcttcttcaataaccccaaagaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagta

SEQ ID NO: 114196 - DNA, 3189 bp, Homo sapiens
  Payload ID: 2320
  Gene Symbol: CA10
  Gene Name: carbonic anhydrase X
  Uniprot ID: Q9NS85
  ENST ID: ENST00000451037
  CDS Start-End: 942-1928
gacccctgcagttgtattgcggaaaatctcgacagcggcgctagttgcgggcgatggaagccaggcaactgggggttctggggagttcaggaaaatagcagaggagcaggaagggcgcgcgcgacctggagagtctgtgtgcccccaccgcgccccagtccccggggcccagcccttcccctcggcgccctggacgcactgccggaacccggctgagaggctgcaggctgcgcgcggacctggggagcagggagggtcggcggaggctgccggcggctggcggtttcgggcaataatccctgcctctctttctctgtgtgtctgctgtgtctgctccttccccgccccccggaagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaag

SEQ ID NO: 114197 - DNA, 410 bp, Homo sapiens
  Payload ID: 2320
  Gene Symbol: CA10
  Gene Name: carbonic anhydrase X
  ENST ID: ENST00000575097
  CDS Start-End: 1-171
cacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggaaaaagtctgctgacccctgaattacagtatgagccattcggaatgcatttctctttaaaagttctcgcctcattcagtgtctggaacacagtgggtgctccccaataggtgacaccttcctcaagtttccttgggagaacagactcaatgtcggatccacaaaggagacctgcacatacctaacccctatttctgcagaagctgaaggctgtattatctattgcttgcataataaatattgcataacaacaa

SEQ ID NO: 114198 - DNA, 2276 bp, Homo sapiens
  Payload ID: 2320
  Gene Symbol: CA10
  Gene Name: carbonic anhydrase X
  Uniprot ID: Q9NS85
  ENST ID: ENST00000570565
  CDS Start-End: 244-1005
gacaagcgcgccgagaaatcctggatcttcccagggattccctctacgctccctcctcttcttcaataaccccaaagagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagttacccagta

SEQ ID NO: 114199 - DNA, 1474 bp, Homo sapiens
  Payload ID: 2320
  Gene Symbol: CA10
  Gene Name: carbonic anhydrase X
  ENST ID: ENST00000575181
  CDS Start-End: 647-1474
cctggatcttcccagggattccctctacgctccctcctcttcttcaataaccccaaagagcaggagaagaactgccccggagcgcagcagccaccctccgaccatgccccggtgaggggggcggacttcgagggcaacttgccgcggactgcctgggcttagccagcgagctacgcgctcccgggagcccggaattgcacggcgcagcccggcggggggctatcgtctatgtcttcttggggcgccagacgaatcggggtctcgtttttgctggaagagcccagtgttggtggcttcaggtggctgctgccgccgccgccgccgccgccgctgctagtgcggtttccgccgctggtgcgaagagaagagacacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcagctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatct

SEQ ID NO: 114200 - DNA, 2699 bp, Homo sapiens
  Payload ID: 2320
  Gene Symbol: CA10
  Gene Name: carbonic anhydrase X
  ENST ID: ENST00000571371
  CDS Start-End: 278-406
acacgcgagcggggagacctccaaggcagcgaggcatcggacatgtgtcagcacatctggggcgcacatccgtcgagcccgaggggagatttgccggaacaattcaaactgcgatattgatcttgggggtgactgtccctggccggctgtcgggtgggagtgcgagtgtgcactcgctcggaagtgtgtgcgagtgtgtatgtgtgtgtgccgtgtcgggctccccccttccccccgttttcccgtcgagtgatgcacttggaatgagaatcagaggatggaaatagtctgggaggtgctttttcttcttcaagccaatttcatcgtctgcatatcaggcgacctcaggagggcagtcaggaggctctggtggcagtctgggttggagatgcaggtaacctgttgaaggtgatggcacacatggagagcaatggccagcatcaggagccgttcaggatgtggattcacagagcctgatgaactgtgtatggtgggggtgagggagaatgctcaacagaattcaccaaaaatccatgaaggctggtgggcatacaaggaggtggtccagggaagctttgttccagttccttctttctggggattggtgaactcagcttggaatctttgctctgtggggaaacggcagtcgccagtcaacatagagaccagtcacatgatcttcgacccctttctgacacctcttcgcatcaacacggggggcaggaaggtcagtgggaccatgtacaacactggaagacacgtatcccttcgcctggacaaggagcacttggtcaacatatctggagggcccatgacatacagccaccggctggaggagatccgactacactttgggagtgaggacagccaagggtcggagcacctcctcaatggacaggccttctctggggaggtgcagctcatccactataaccatgagctatatacgaatgtcacagaagctgcaaagagtccaaatggattggtggtagtttctatatttataaaagtttctgattcatcaaacccatttcttaatcgaatgctcaacagagatactatcacaagaataacatataaaaatgatgcatatttactacaggggcttaatatagaggaactatatccagagacctctagtttcatcacttacgatgggtcgatgactatcccaccctgctatgagacagcaagttggatcataatgaacaaacctgtctatataaccaggatgcagatgcattccttgcgcctgctcagccagaaccagccatctcagatctttctgagcatgagtgacaacttcaggcctgtccagccactcaacaaccgctgcatccgcaccaatatcaacttcagtttacaggggaaggactgtccaaacaaccgagcccagaagcttcagtatagagtaaatgaatggctcctcaagtagggaacaaagccaagaagaatcccacctcagtgaaatgctacaactgtgaattgacgtaacctagaatgtcccccttcttgcttctctctccttctttcccccaagcctcattcattcttgggattggccctttcttcatgaaaagtgtctgcaaaaccatggcagaggaatacatctctcacacatactcacaaacacacacacaagcacttgcacatacatacaaacacatgcaaacatacctacacacacacacactcttacaacctccatcatgggaagtcaagtttcagaaacaaaagtctcattcataagaggtcttagaagaaaataaccagttaacctgatttcaattttgataccgttttcctgaactaataaatctacccaatgagacttttcagcctttgtacatacaaaattcttccaaaagagagaggagaaaatacagctctgatggcatcaaacggactttgcatcaagtaatttcagatagtgtcctaggatcctttgagggtgctggtagcaggtgagcaggacaaagttgaccaaggacacttatttctagattatgattcttctgtttactcaacaatttacaaagaaaaaaaggacagacattgaagagctacacattgtatatatatcaccacagactataaggaaatggaattatttccctctttgtcacatatctgtagtaggatttgccaagatcagaaatgatccatttgctgtttcttgttttccaaaggtcatacattgtgtttggttattgttaccagctcaataaatgtgtttaacgagttaatttcatttttctggctttggtctgttctccttccttacaggctaagccctggctccatgcaactgcattctttgatttcacttgttccttcatctacatgttttgttcatttgcagccagtttttactgagtttgtggcaatcaggaatgcatttgctaagcaagtatgactttaattccactccatggctcaatcattcacatgaggtgagcttcagcctgagatagcaggcgacagacttcttgcgtttcaaaactgccatgcccccctgtgatgctcccgtgaaggaatgcactttgccttgtaagttcctgggaaaggggtatgttttctctccaggtgcagccagatctcacaaagtacaaaacgaatgcctttcttttcttgtttataatggtcactcactgtgtttggttactgtcaagaaatcaataaatgtgtttaacaagtta

SEQ ID NO: 114201 - DNA, 1844 bp, Homo sapiens
  Payload ID: 2321
  Gene Symbol: CA11
  Gene Name: carbonic anhydrase XI
  Uniprot ID: O75493
  ENST ID: ENST00000084798
  CDS Start-End: 681-1667
atcccaccccaagccaacccgaggagtgtttgccgctatgagatcacctgctcccccagcccaacaacaaaattaaataacaccacgggagaggagagagggagggggaggagggaggaagggacaagagagaagagagactgaaacagggagaagaggcaggagaggaggaggtggggagagcacgaagctggaggccgacactgagggagggcgggaggaggtgaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagcagaggaaagaggaaagacacagagagacgggagagagaagaagagtgggtttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggatgggggctgcagctcgtctgagcgcccctcgagcgctggtactctgggctgcactgggggcagcagctcacatcggaccagcacctgaccccgaggactggtggagctacaaggataatctccagggaaacttcgtgccagggcctcctttctggggcctggtgaatgcagcgtggagtctgtgtgctgtggggaagcggcagagccccgtggatgtggagctgaagagggttctttatgacccctttctgcccccattaaggctcagcactggaggagagaagctccggggaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgtggatggtgtcccccatggtcgctgagactccccttcgaggattgcacccgcccgtcctaagcctccccacaaggcgaggggagttacccctaaaacaaagctattaaagggacagaatacttcctgttttctcagtggtctgattctaggcgcggtggggaaacatttgggtattaaagaacagacttcttccggaaaccaa

SEQ ID NO: 114202 - DNA, 498 bp, Homo sapiens
  Payload ID: 2321
  Gene Symbol: CA11
  Gene Name: carbonic anhydrase XI
  ENST ID: ENST00000596080
  CDS Start-End: 1-341
atgatgcctactttcttcaagacctgagcctggagctcctgttccctgaatccttcggcttcatcacctatcagggctctctcagcaccccgccctgctccgagactgtcacctggatcctcattgaccgggccctcaatatcacctcccttcagatgcactccctgagactcctgagccagaatcctccatctcagatcttccagagcctcagcggtaacagccggcccctgcagcccttggcccacagggcactgaggggcaacagggacccccggcaccccgagaggcgctgccgaggccccaactaccgcctgcatgcccagtgcttctcgacctagtacattctggttccccgctcgcagacttccgacgtggatggtgtcccccatggtcgctgagactccccttcgaggattgcacccgcccgtcctaagcctccccacaaggcgaggggagttacccctaaaacaaagctattaaagggacagaatactt

SEQ ID NO: 114203 - DNA, 6413 bp, Homo sapiens
  Payload ID: 2322
  Gene Symbol: CA12
  Gene Name: carbonic anhydrase XII
  Uniprot ID: O43570
  ENST ID: ENST00000178638
  CDS Start-End: 442-1506
ggaccagtgacagaccaagggcatgccactgaaggaatccctagacgcacccttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcatccaattttcactataatcaccctaagcctgagagaggtgaactgttcaagggtactttggctccagtgggtgacagtacctggcccagctttggaattgaaacatttctgatggtctgtactctgctagaacacaggatgcttctgctctccctgctctggcatcctgccaggtgtcatggccacgcacaggcatgaagacagccgggaagccagagttcccacgaagcactcactccttggacttgctcccaccccactggggagagcactcctggagcaggaaatgagcatctctcatctccctgaattccacatccactggctgaatgatcagggaggcatagcagtgagagccataggtcggcagagggaactcaggccctcctttaggatggccatcacctcatctcaatccagccaaatcaaccatctagagcacacaggccgagagaaatgtaataaaatataacatgagacacgtatgaaatttaaactttccggtagccacactagaaaaaggtaaaaaaaaaaaaaccagtgacattaatttaaatttaattttagataatccaacagatctaaaatactatcatttccacatgtaaccagtattttcatgtgtttttttctgcagtaaatctttgaaatctggtgtgtgttttacactgacagcacactcgattcagatgctagattttccttgtagatatttggtcgttatttagatttcataaaatttacagtttaaaagattccaatatccgagttgctccaaacacacttagaagttgttttccaaataatggaatcaatgatcggcttttagatgtaaacttattaaaataaagtagcgtttctcagttaagtcacattccaagcgctcaagatccatgccctgcgcagacccggacgacgaacccgactttcagagactgagggttctgcctagagagctcccacagaaatcagcccgagaagaaagccttgtgggtgaagccagggagggagacaggagggcaggaggaaaatcaagcctaaatgagcacatcgtggacgccgctcttcctctccccacatctcctcgcctcgccgcagtgggcccggctgtgccccaggtccccgcggtcgggagtgaatggcgctcgggtggcaggcacgtgggcacctggtgaactgcaggaccctggcaccgccaccccctcgcccctacacacacaggagtgcccctcccgttgtcacgtggccttcctgctgggtatctggagcagttgcagcctcgcttccggaaggaaacggggcctctggggcacagggaccacctgccagtgcgttccagccgggctgccatccacactggagaccgccccgcacgtggtcctcgggctcggattcagctgtcgcaggatgtgaggggaaaggtatgtggcccgacaatgccaccgagggtgtccccgggctccaccccgtgcctcttcattatagaatgactgggcagagataagggccagattactttgctgtattgaataattcaccataaaaatgattgcaaccagg

SEQ ID NO: 114204 - DNA, 2744 bp, Homo sapiens
  Payload ID: 2322
  Gene Symbol: CA12
  Gene Name: carbonic anhydrase XII
  Uniprot ID: O43570
  ENST ID: ENST00000344366
  CDS Start-End: 116-1147
gtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaa

SEQ ID NO: 114205 - DNA, 2556 bp, Homo sapiens
  Payload ID: 2322
  Gene Symbol: CA12
  Gene Name: carbonic anhydrase XII
  ENST ID: ENST00000422263
  CDS Start-End: 127-978
gaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttgtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctc

SEQ ID NO: 114206 - DNA, 3815 bp, Homo sapiens
  Payload ID: 2323
  Gene Symbol: CA13
  Gene Name: carbonic anhydrase XIII
  Uniprot ID: Q8N1Q1
  ENST ID: ENST00000321764
  CDS Start-End: 303-1091
atcccccccggaaacctttctctctccgtctctccctctaactcaaatctctcattcccgagtccaaactaagagagactcgcgccccaggagtcagccagcggcgcgggcgccttccccgcacgcctctgccgtctggaggacgcaggcgggagcgccccggaccgggttcacggtctcgcactcctgccgccggcgccccgcggtcccgccctagcaggctccttcccgggcccctccccgctccctcctctttctcgctgctcagtcacatctttctcttccttccaccccgagggaccatgtcgaggctcagctggggataccgcgagcacaacggtcctattcactggaaggaatttttccctattgctgatggtgatcagcaatctccaattgagattaaaaccaaagaagtgaaatatgactcttccctccgaccacttagtatcaagtatgacccaagctcagctaaaatcatcagcaacagcggccattccttcaatgttgactttgatgacacagagaacaaatcagttctgcgtggtggtcctctcactggaagctacaggttacggcaggttcaccttcactgggggtccgctgatgaccacggctccgagcacatagtagatggagtgagctatgctgcagagctccatgttgttcactggaattcagacaaataccccagctttgttgaggcagctcatgaaccagatggactggctgtcttgggagtgtttttacagattggtgaacctaattcccaactgcaaaagattactgacactttggattccattaaagaaaagggtaaacaaactcgattcacaaattttgacctattgtctctgcttccaccatcctgggactactggacatatcctggttctcttacagttccacctcttcttgagagtgtcacatggattgttttaaagcaacctataaacatcagctctcaacagctggccaaatttcgcagtctcctgtgcacagcggagggtgaagcagcagcttttctggtgagcaatcaccgcccaccacagcctctaaagggccgcaaagtgagagcctctttccattaaaaattgtcaccaatgaactcccccaaacatggctgtggagagacaacaaaacaaaacaaagcacaaaagtctctgccaacaactcttttgtggaattctaatttataggaaacattttagtatgagcttcagtgtcacaaagaaaaccagatctctctctcttttttttttattttttttagtgatagagtctcactctgtcacccaggctggagggcagtggtacagtcttggctaattgcagcctccaactcctggactcaagtgatcctcccacctcagcctccagagtaagtaggaccacaggcatgcacaagcatgcctggctaatttttaaattttttttttttaagaaatagggtcttgctatgttgcccaggctggtctcaagctcctgccctaaagtaggcctcctgcctttgcctctcaaagtgctgggatttcaggcatgggtcatcaagcccagctgacccagagctctttactaacttatctgtctcttatttgcactcatggatattcacagtaagcattgtttgacatatattaaaacccatgaaatatgtctacttcaacctgtgtgaaaatatagttaacattgcaaactttagaatgtattaaaaattttaccttgccatagagactgaattagtcacagctctcagtgatgttagatggaaacttatatctcaaatgataggattgtgatgctttttttgtaacaagtgattctgcttaatattttgttattccagttcataaaaagtagattacgttttcctataaggataatttttgcagtgattatattgctaactctcattgcatgatacctttaataaaatgaacaatataagagttaagggcaatgggataaagctacttaatgtgtctcctccactgatcaaaaatattccatatagtcttggtgaggaattccccaggatataaatggctatttacactgtaatgaattataccatatatgatattcactcagtaatgttaataatgaactggctaataattgacaagatgcagtgcctgccagtttatgacattaacttggtttgaaactaacatatgacatagtaccagtgcagtcagagctgcccttaggcatgatgaacatgtggcccgtttttgcctggtgttttggcagcaaagcaggaagcaattttgtgtgggtcattgttctgtcaatttgtggaaaaaattacttcagtctcatataaatatagaatgggtccataaacccttcaactcatttccatggcaaaactcacttttctttttatacatgtccttcagtctcttaattttgtcaggtggagcttgatcttaattttaacctattatcttttatttttgtttgtttttggtgaaggataagagtggtgtttcttttgccctttctggtacaaacagagggacactaagcattaacttaataatcacatttaagacttgaacacatgctacccttttgtcatcttctgacataagtttacctgagtttccttgatttggaagatttgtttcttttatctctcttcctctggatgtagtttttttttgttttttttttgtttttggacggagtcttagtctgtcactgaggctggagtacagtggcacgatcttggctcactgcaacctccatctcccgggttcaaatgattctcctgcctcagcctcttgagtggctgggattacaggcacatgccaccacacccggctaatttttgtatttttagtagagatgggttttgcaatgttggccaggctggtctcaaactcctgacctcaagtgatctgcctgcctcggcctctcaaattgctggaattacagttgtgagccaccacacctggcttgaatgtagattttaataattgaatttattctgccgtgttgatagaataactgaatatcagtaaattgtgtaacagtggtggatactgttgcataagatgagctcctgaagagtgaagctaattctttggtcaatgttcttttcccctcagtgtctagtttaaggcttttagaagattgatctgtagcaattatttaatgaattgaatatttaaaaaattttttatttgctgtctttggtaattatctctctgcttgaaattaaatgcactataagttaatataacaagtaaaatacattgtcttttgaaaatagtttctttttaaaggaatactaattaattgtaacttgtaaaaccaaaagttctaatggtttttaaaaaccagtgttgagtggaaaagtgtttctttagtttggaaagacctgtgaagtatcctagtcagggaaagaacctgttttctggaagaatgtaagttgctatatgtggaggggcatgtaggacaggggttctaattactgtctgtgagagttactactttgtaacttatggtttctgcttcagtattgtgttggttctgtattataaattgcaccttaatagaccaaaaatatctatacagcactgatttccttgaatattgtgtgttaattgatatatcttctagaggcaaaaggtttaaatgtgttaaaatggttatattgcctcctttttaaacaaattaaagagttgtaaatactagtgtagatctcttttgtttaccacagcaaatactgattttatgattgttaagcatttcatattttaatttaaattggattcaaccacaataaagaaaatgagaaaagcttt

SEQ ID NO: 114207 - DNA, 2403 bp, Homo sapiens
  Payload ID: 2324
  Gene Symbol: CA14
  Gene Name: carbonic anhydrase XIV
  Uniprot ID: Q9ULX7
  ENST ID: ENST00000369111
  CDS Start-End: 971-1984
ttatccagcaaacaacgctccctccccgcactccccccaccccaggccacacaggcacgtggacccaggcctcaccgtgggaagggggtggtggcaggcacagaagagattgctccagatgagttctccttgcctcacttctcttccttagaacttaggacacaactcaggttttagttattgacttcctccacccctcccctgcaccctgagtccctaattccttcttgttatatatctcctaattctggactcttcccattccagggcagctcagattatgcagggaattgggaacaggtacccccaccatctgccgcataccacccagggagctgctcctcagaggagaaatcaggcggggggatgaaaatacagtgtccttttgagggggctgagttgaaccccaaagccccttccttgaccctgcctgctccagggaacacccatctaaacagcatctgtgtgactagcagaggaaggaagagctcaccccagctgggctcctgagccagggccagggctccagtgaaacttgccgcgctccagctccgagtggggccatcctgcatgcctaattggctatttaaggagctgttcaccagcagcccaggcagcacccccgtccccacatacaccagttcagagccaccttaaaagcaggaggcagttgtaaagtcgctggccagctagtggagtggagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgactttaa

SEQ ID NO: 114208 - DNA, 594 bp, Homo sapiens
  Payload ID: 2324
  Gene Symbol: CA14
  Gene Name: carbonic anhydrase XIV
  ENST ID: ENST00000607082
  CDS Start-End: 1-393
cagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaaggatcctcgtataccacaggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgt

SEQ ID NO: 114209 - DNA, 938 bp, Homo sapiens
  Payload ID: 2324
  Gene Symbol: CA14
  Gene Name: carbonic anhydrase XIV
  ENST ID: ENST00000483993
  CDS Start-End: 36-164
aattcccagtcccctgcaccccttcctgggacactatgttgttctccgccctcctgctggaggtgatttggatcctggctgcagatgggggtcaacactggacgtatgaggctcctcccttctggatctcctcctgccttgagtttcacatatatggctcctagatcctgctctaatcatcaaatcctacacctcctgatttggcagaaaagctaggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagccctt

SEQ ID NO: 114210 - DNA, 1293 bp, Homo sapiens
  Payload ID: 2325
  Gene Symbol: CBR1
  Gene Name: carbonyl reductase 1
  Uniprot ID: P16152
  ENST ID: ENST00000290349
  CDS Start-End: 176-1009
agccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtc

SEQ ID NO: 114211 - DNA, 838 bp, Homo sapiens
  Payload ID: 2325
  Gene Symbol: CBR1
  Gene Name: carbonyl reductase 1
  ENST ID: ENST00000399191
  CDS Start-End: 82-750
gtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagac

SEQ ID NO: 114212 - DNA, 1024 bp, Homo sapiens
  Payload ID: 2325
  Gene Symbol: CBR1
  Gene Name: carbonyl reductase 1
  ENST ID: ENST00000439427
  CDS Start-End: 102-638
acgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaaggtgagtctgatgggaaacagcgcaccttctctttggggcttgatttggcccctgcttgcctgggatttctcctgcaggctcctgcttcctctccatgctgcacgtgcactgacctctgtgctttttctcctgccagctgatatgtgccattttgcctcaggactttgtcctcacttctcccactcccatggccattcgtcctccctgtcgcactggtctttgcacacctggctgactctcatccttcaggtcttagctcaaacgtctcctgagagatgctctttatttgctccattcccctctgcgtgggagtccatcctgtaccctttctctgctctttcagagagatcttattcaggctggtggaggctttactaccaccagttcattaggcccttctaatacctgtcacctgtctgaaacactccttaagctcccaaccacatggttgtcttgctgcctttccatctcttcctgatgcctttccccacaatctaagatatttccagaggatccctatcctttt

SEQ ID NO: 114213 - DNA, 1924 bp, Homo sapiens
  Payload ID: 2325
  Gene Symbol: CBR1
  Gene Name: carbonyl reductase 1
  Uniprot ID: P16152
  ENST ID: ENST00000530908
  CDS Start-End: 176-697
agccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagcatcctgcgtactgtctgcatggtcatgcctctcccaaaatccttcaggaggaaagtccaagcccttagcatggttcacagagatgtccataatctgccgctgcttaactctgggcccattttaactccccttcaacgtgctgaaggtgctggacatgactatcacatgtctttggttgtaaactgctgtgatagttaccctaagtaatgggacaggagatgaacccacccattaaataacacagcaattaagcagccacttttagaaaaatttaaatgtgtggcttcgagttgggtacttgcatgtacagcttactctcagcttttatcctgtttccctgtcctgtcgtcctgttaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtc

SEQ ID NO: 114214 - DNA, 1169 bp, Homo sapiens
  Payload ID: 2326
  Gene Symbol: CBR3
  Gene Name: carbonyl reductase 3
  Uniprot ID: O75828
  ENST ID: ENST00000290354
  CDS Start-End: 282-1115
cggacacctcgcagatcaccccgcggctcagagcccggatcctgaagggcgcagcgtgggcagggggcgggcccgggagttggaacagagggcacagacggcccctcctcggaggggagggaccggagccggggcctttttctttaagactcgcagcactggatcccagaacttagtctgcgcggcggcattgacactagctgggctcctcggggcgcgccccaggtggtccgaagcccggtccgccctccacgcaggtgccccgcgctccccgctcagccatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatgaatgaatgaa

SEQ ID NO: 114215 - DNA, 3443 bp, Homo sapiens
  Payload ID: 2327
  Gene Symbol: CBR4
  Gene Name: carbonyl reductase 4
  Uniprot ID: Q8N4T8
  ENST ID: ENST00000306193
  CDS Start-End: 170-883
attactattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccaggatttgtacacacagatatgacgaaagacttgaaagaagaacatttaaagaaaaatattcctcttgggaggtttggagaaactattgaggtggcacatgcggttgtgtttcttttagaatcaccgtatattacagggcatgttctggtagtggatgggggattacaactcattttgtaatttgcagattattcagttataggggtgattagcatcaagggcacactttggctactgattagacaattatacctacatgggtaacatgtgctaatcaaacctgctgatgctacaaatgttaatttctgtctttataaaaatatgtctcaaaagaacaatgtgtgacaaattgtggtttttttttttttggtctaagttacatcagtgttgttttgtttaaaaagccttcatgagatacaattcacataccatataatcacacatttaaaatacacaattcagtggttttaacatatttaaatacatgtgcaatcatccccccagacaaattgtgttttctaaaggatgtgtatcacttacctttggttacctcatagactgtagcaatcttagtgtatagacattttgcaagtcatataaacaagtattgatttatatattttgtctcaaaagtggaaaaattatattgtctaattatgatgaattattttcttgtatcaagctgaattttctaaaagttaaccttgtgggctgttgccaaaataagagtatttagaggacactgattagttgtcaatactttagcaagcccactaaagataactatattccttttgcatgtgcttgggtgatcagtttttatacaggttgcaaaacatagtattcattaaagacatgaatttagaattgatttctttgagtggtatttctcttgattgagcagctagacaaaataatctgcaaatttaaatgtggcgcatttgactcattcttgagaaattctcataagtgaagaggattagcccttaaggttttaatacctggtacagtagtgaaccgcacagatttcatgaacttaggatgtgttttttattcatgaaaaacttagaatagtgaactattaatatttaaaaacgagaaatacaacatttaaaaaattaagagtattttgcattagtgattatgattcttatcccaaaattctagaaagtaataaattctgtatgaataagcataaaaaataaataaatatgcaataacattaaattaaatgtctttacaagaagcagtgaaggcactggtcttaagtgagaatatttgcctgggagtagagataaagacacaaaccgaatgtgaaataccaggtaataattattttgcattaaactctttttatcgggaatagtatgatattttcagtgtcactccattcatgttgatttggagctgacagttattttgtgtaagcagagatttaattttatattgaaagtcagtgcaaaattatgaataggatatactaataaatacaaagtaataacaaaagtcaaagcagtgttctaaataaaaattctgggttccttaaaaattattttaaatttatctttgaaatagttttcttagattaatctcaggatatgagaaagtcaattaagtgtgagtaaagttagtatcattaaacaaattgtctattaaatgcaagacgtggtaatatacagaatttatcaggcattaccaagtctaggcacatataggaaatgcagcactcagaatggtttcaatgtagtagttgatgcttgtaaggtaggggagcttattcagacatagtagatagtttctctaatgctgtctcaattgctggcctttggctacctgtacttccccattatggcagcccattcagtcttgagttttcttctctggacaccttatgctctgaaatcatgagcgaggctgattcaattggtgatttgggtagaaagcagtatgttttgctgacattaagatgtaggttatagataggtttagcctttaagtgtatgtttttatactttaaaataagaaatataaccttttaagctattccacctcctcccccagcctatctcaaactggtggaatatatggagagatcttgaaagaggtaaaataaaccttcactgctccactccaggtgaatccgcccactcccactgacctagtagaatttgtaatttaatacttaccttctatttctgaaatcagttgtgaactgttgccttatgttcagaggtttaagaacctcagtgaattcattttttaaaatctgctattctgagaagcattgaatgaattcttaacaagaagactcatctgtagctgtttgctgactcctatgagcccataagggttctgtgcttagcattaacaaaataaggtttataggtaaagccaatgtattaatttttttttgcatggagggctttaaaatttgtgctctttttcatattttattcatattcaatttatggtttgtaactgctttttagggagataattatatgttataaattagttttggggggaataattgtgcaaagaggataatttaatttacgtgcttctgttattcagaataaagagagaagactacgctgcatattcaagagttgtaccttaacattggtgaaacattttttctaagattttcaaaaggaatatgtgtaaattgagaaatcataaccactgtcctaacttggtaaacaaactgttcttaaataaagtatttaatgattttaaa

SEQ ID NO: 114216 - DNA, 562 bp, Homo sapiens
  Payload ID: 2327
  Gene Symbol: CBR4
  Gene Name: carbonyl reductase 4
  ENST ID: ENST00000506808
  CDS Start-End: 162-344
tgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcgagatcttctcgcctcagtctcccaaggacctgggactatagacgccaggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgc

SEQ ID NO: 114217 - DNA, 1052 bp, Homo sapiens
  Payload ID: 2327
  Gene Symbol: CBR4
  Gene Name: carbonyl reductase 4
  ENST ID: ENST00000504561
  CDS Start-End: 1-561
gtgtgtgctgtttttggaggctcccgaggcattggcagagctgtggcccagttaatggcccggaaaggctaccgactggcggtcattgccagaaacctggaaggggccaaagccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggccacagaagggagatgctgctccataaaagaagcattgttggcttaaaaggcaactctggccagtccgtttacagtgccagtaaaggaggattagttggattttcacgtgctcttgctaaagaggtagcaagaaagaaaattagagtgaatgtagttgcaccaggttagtgaaaactttattaaaataacttgattatgattattgttttatagggaagccattatttggaacattagtaattgacatctgggtagaatagtttgtaaaatgattgtgaaaagaatcaaataatgaactgggggactcaaaaaaattttttgtacctcatattctatataaagtctatgtgttagcctgtttgcattgctctaaaggactgtctgaggtaattcataaaaaaaagaggcttatttggctctcgggcctgcaggctgtacaagcatgacaccaacatctgctcagcttctggtgaggcccaggaaactttttttcagtcatggcggaaggtaaagaggtagcagccaagtcatatggggatagcaggagcaagagagagaggaggtggcaggctctaaacaaccagctctggcatgaactaacagtgagaactcattatttaccatgtggagggcaccaagctattcatgaggaatccgcc

SEQ ID NO: 114218 - DNA, 1198 bp, Homo sapiens
  Payload ID: 2327
  Gene Symbol: CBR4
  Gene Name: carbonyl reductase 4
  ENST ID: ENST00000510042
  CDS Start-End: 170-325
attactattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcgggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccagaactcatcccaagaacagtatccataaggaagatggaaaagggggacagaataaatgttaccctaagaagtccagagcaacatggtacctgattagctgtttcctcttctggctcctgaatattaaagacagttgcactgtcagcacctagcagtcgacgagccattctttcttcgtatgttaacctctaaacaacatttaaacaacggaaaaagccactgaagtatgtatagtatctgtgcgccgagatacacaggaaagcatggaacatgtggatggaaggaaccgggatcatctcatccagctgagtaataagtacgtttggtgcagtgccacacaggaggccaccaacagagcccagagtagtaactaggttgcttcactcttagcctctcaagtgatgacaccaaggcatgatcttatctcttgattgtggccacccgtaaagaaaagcgtatctctaatctcagaagcacaaggagttcataccaggaaaccaagattagtaagtatttttgtggtgaataccttttgaataagacaggattaatgtaacagttaaaagtatagaaatataaaagttacgaacttactggtgatttttttctttggtgt

SEQ ID NO: 114219 - DNA, 547 bp, Homo sapiens
  Payload ID: 2327
  Gene Symbol: CBR4
  Gene Name: carbonyl reductase 4
  ENST ID: ENST00000507752
  CDS Start-End: 187-369
ttttcacggcgtcttgcattactattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcgggcttcccattatgttgcccgtgctggaccccaactcctgatttactggctctagagatcttctcgcctcagtctcccaaggacctgggactatagacgccaggagatcatttggcatttagctgtgatgttgctaaagaacatgatgttcaaaatacatttgaagagctggagaaacatttaggtcgagtaaatttcttggtaaatgcagctggtatt

SEQ ID NO: 114220 - DNA, 1602 bp, Homo sapiens
  Payload ID: 2327
  Gene Symbol: CBR4
  Gene Name: carbonyl reductase 4
  Uniprot ID: Q8N4T8
  ENST ID: ENST00000504480
  CDS Start-End: 166-705
ctattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccaggttagtgaaaactttattaaaataacttgattatgattattgttttatagggaagccattatttggaacattagtaattgacatctgggtagaatagtttgtaaaatgattgtgaaaagaatcaaataatgaactgggggactcaaaaaaattttttgtacctcatattctatataaagtctatgtgttagcctgtttgcattgctctaaaggactgtctgaggtaattcataaaaaaaagaggcttatttggctctcgggcctgcaggctgtacaagcatgacaccaacatctgctcagcttctggtgaggcccaggaaactttttttcagtcatggcggaaggtaaagaggtagcagccaagtcatatggggatagcaggagcaagagagagaggaggtggcaggctctaaacaaccagctctggcatgaactaacagtgagaactcattatttaccatgtggagggcaccaagctattcatgaggaatccgcctccatgacccaaacacctcccgctaggcccacctccaacattgggaatcacatttcaacatgagatttggaggggacagacatccaaaccataagagtctttatttttaaattttgcactagtggaataacttaaggtggagagggtcttagaaataattttttccagtcatttttgtagattagaaaactgtacctgggattcagagtgacttgcctaaggttacacagctagtttatggaagaactgttactaaaagctttgtcttttgatttccacctaatgggagcttaaaaataatgtcctaccaggtatggtagctcatgtgggaggctgaggcaggagtattgtgaggccaggagttccagatcagcctgagcaacatagcaagatgctgtctgtaccg

SEQ ID NO: 114221 - DNA, 2384 bp, Homo sapiens
  Payload ID: 2328
  Gene Symbol: CEL
  Gene Name: carboxyl ester lipase
  ENST ID: ENST00000372080
  CDS Start-End: 17-2287
ggccacccagaggctgatgctcaccatggggcgcctgcaactggttgtgttgggcctcacctgctgctgggcagtggcgagtgccgcgaagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaagggaccctgaaggccaagaacttcaagaagagatgcctgcaggccaccatcacccaggacagcacctacggggatgaagactgcctgtacctcaacatttgggtgccccagggcaggaagcaagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtaactatggccttcgggatcagcacatggccattgcttgggtgaagaggaatatcgcggccttcgggggggaccccaacaacatcacgctcttcggggagtctgctggaggtgccagcgtctctctgcagaccctctccccctacaacaagggcctcatccggcgagccatcagccagagcggcgtggccctgagtccctgggtcatccagaaaaacccactcttctgggccaaaaaggtggctgagaaggtgggttgccctgtgggtgatgccgccaggatggcccagtgtctgaaggttactgatccccgagccctgacgctggcctataaggtgccgctggcaggcctggagtaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 114222 - DNA, 1213 bp, Homo sapiens
  Payload ID: 2328
  Gene Symbol: CEL
  Gene Name: carboxyl ester lipase
  ENST ID: ENST00000621209
  CDS Start-End: 14-193
cacccagaggctgatgctcaccatggggcgcctgcaactggttgtgttgggcctcacctgctgctgggcagtggcgagtgccgcgaagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacaggggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactctcaggatgcccctgtgcccctcacaagtgactctgaggctgcccccgtgtccccctcaggtgactctgaggctcccccgtaccccctacgggtgactctgaggcccgtgcccaccttgggtgacactgaggctgcccctgtgtcccccacagatgactccgaggaagctcagatgctgcagtcattagtttctagtgtcccatcagccttggtctcaagaggccgagagggtgcaaccccaggggctcccctcccatcttgagctcttcctgaataaaacctcattcccc

SEQ ID NO: 114223 - DNA, 2006 bp, Homo sapiens
  Payload ID: 2329
  Gene Symbol: CES1
  Gene Name: carboxylesterase 1
  Uniprot ID: P23141
  ENST ID: ENST00000360526
  CDS Start-End: 104-1810
agggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcca

SEQ ID NO: 114224 - DNA, 1835 bp, Homo sapiens
  Payload ID: 2329
  Gene Symbol: CES1
  Gene Name: carboxylesterase 1
  Uniprot ID: P23141
  ENST ID: ENST00000361503
  CDS Start-End: 132-1835
aattagaggattaggcaattggcagcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtga

SEQ ID NO: 114225 - DNA, 2178 bp, Homo sapiens
  Payload ID: 2329
  Gene Symbol: CES1
  Gene Name: carboxylesterase 1
  Uniprot ID: P23141
  ENST ID: ENST00000422046
  CDS Start-End: 283-1983
gtagttgggcaagtttacagctctctgtaatctgacagtagagtccagactggtttgatgaaagagggtaaactgtgggtgggcgtggcctgaggccccactagaagcccagggagatctgaggaaagggagggcttttctgatctctcccaattagaggattaggcaattggcagcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 114226 - DNA, 659 bp, Homo sapiens
  Payload ID: 2329
  Gene Symbol: CES1
  Gene Name: carboxylesterase 1
  ENST ID: ENST00000565568
  CDS Start-End: 1-135
gaaaggaatttccacactgtcccctacatggtcggaattaacaagcaggagtttggctggttgattccaatgatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaa

SEQ ID NO: 114227 - DNA, 509 bp, Homo sapiens
  Payload ID: 2329
  Gene Symbol: CES1
  Gene Name: carboxylesterase 1
  ENST ID: ENST00000563241
  CDS Start-End: 1-396
aaggaactgattccagaagccactgagaaatacttaggaggaacagacgacactgtcaaaaagaaagacctgttcctggacttgatagcagatgtgatgtttggtgtcccatctgtgattgtggcccggaaccacagagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtg

SEQ ID NO: 114228 - DNA, 659 bp, Homo sapiens; identical to SEQ ID NO: 114226
  Payload ID: 2329
  Gene Symbol: CES1
  Gene Name: carboxylesterase 1
  ENST ID: ENST00000561966
  CDS Start-End: 1-135

SEQ ID NO: 114229 - DNA, 499 bp, Homo sapiens
  Payload ID: 2329
  Gene Symbol: CES1
  Gene Name: carboxylesterase 1
  ENST ID: ENST00000569260
  CDS Start-End: 1-253
gcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgggaacagcagacatcagcgtctactaagagagtggatggtcagaggaagatgaggatggaaaagctacctaatcgggtgctatgctcaatacctgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttga

SEQ ID NO: 114230 - DNA, 1991 bp, Homo sapiens
  Payload ID: 2329
  Gene Symbol: CES1
  Gene Name: carboxylesterase 1
  Uniprot ID: P23141
  ENST ID: ENST00000576783
  CDS Start-End: 96-1796
aactctgggcggggctgggcgccagggctggacagcacagtccctctgagctgcacggagacctcgcaggcccccggaactgtcgcccttccaggatgtggctccctgctcttgtcctggccactctcgctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 114231 - DNA, 518 bp, Homo sapiens
  Payload ID: 2329
  Gene Symbol: CES1
  Gene Name: carboxylesterase 1
  ENST ID: ENST00000576185
  CDS Start-End: 1-405
tgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtg

SEQ ID NO: 114232 - DNA, 499 bp, Homo sapiens; identical to SEQ ID NO: 114229
  Payload ID: 2329
  Gene Symbol: CES1
  Gene Name: carboxylesterase 1
  ENST ID: ENST00000574235
  CDS Start-End: 1-253

SEQ ID NO: 114233 - DNA, 1958 bp, Homo sapiens
  Payload ID: 2329
  Gene Symbol: CES1
  Gene Name: carboxylesterase 1
  Uniprot ID: P23141
  ENST ID: ENST00000571922
  CDS Start-End: 60-1763
acagtccctctgagctgcacggagacctcgcaggcccccggaactgtcgcccttccaggatgtggctccctgctcttgtcctggccactctcgctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 114234 - DNA, 1997 bp, Homo sapiens
  Payload ID: 2329
  Gene Symbol: CES1
  Gene Name: carboxylesterase 1
  Uniprot ID: P23141
  ENST ID: ENST00000574513
  CDS Start-End: 96-1802
aactctgggcggggctgggcgccagggctggacagcacagtccctctgagctgcacggagacctcgcaggcccccggaactgtcgcccttccaggatgtggctccctgctcttgtcctggccactctcgctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 114235 - DNA, 3927 bp, Homo sapiens
  Payload ID: 2330
  Gene Symbol: CES2
  Gene Name: carboxylesterase 2
  ENST ID: ENST00000317091
  CDS Start-End: 985-2856
gtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaaaa

SEQ ID NO: 114236 - DNA, 3868 bp, Homo sapiens
  Payload ID: 2330
  Gene Symbol: CES2
  Gene Name: carboxylesterase 2
  Uniprot ID: O00748
  ENST ID: ENST00000417689
  CDS Start-End: 1001-2824
gtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatgttaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctg

SEQ ID NO: 114237 - DNA, 3391 bp, Homo sapiens
  Payload ID: 2330
  Gene Symbol: CES2
  Gene Name: carboxylesterase 2
  ENST ID: ENST00000568470
  CDS Start-End: 974-1342
gacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggtgaggctccctcggaggggcgacagggaccgggctcagatctgccaaatgctgcggaggcagaacctgacagtgcgggagggcaggcgcctgggaggtaggagctggtggagatgacagcgtggaactcgtgagccccacgcaacgcctccccgccgcccaaggtgggctcctagaagcacagaaagggtcgggctgggggacaccacggcaaggaaccagcggagtacaggggccccaggagcgccgggacatgccaggccgggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctc

SEQ ID NO: 114238 - DNA, 739 bp, Homo sapiens
  Payload ID: 2330
  Gene Symbol: CES2
  Gene Name: carboxylesterase 2
  ENST ID: ENST00000570032
  CDS Start-End: 110-478
gcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggtgaggctccctcggaggggcgacagggaccgggctcagatctgccaaatgctgcggaggcagaacctgacagtgcgggagggcaggcgcctgggaggtaggagctggtggagatgacagcgtggaactcgtgagccccacgcaacgcctccccgccgcccaaggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatc

SEQ ID NO: 114239 - DNA, 891 bp, Homo sapiens
  Payload ID: 2330
  Gene Symbol: CES2
  Gene Name: carboxylesterase 2
  ENST ID: ENST00000566182
  CDS Start-End: 827-891
cgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgct

SEQ ID NO: 114240 - DNA, 918 bp, Homo sapiens
  Payload ID: 2330
  Gene Symbol: CES2
  Gene Name: carboxylesterase 2
  ENST ID: ENST00000561697
  CDS Start-End: 543-918
cggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaacc

SEQ ID NO: 114241 - DNA, 862 bp, Homo sapiens
  Payload ID: 2330
  Gene Symbol: CES2
  Gene Name: carboxylesterase 2
  ENST ID: ENST00000564420
  CDS Start-End: 1-605
aagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatgttaaattcactgaggaagaggagcagctaagcaggaagatgatgaagtactgggccaactttgcgagaaatgggtgagacagcacacccctgcctcaacctccccgattgggggacttgtgcccatccagtgctctcctagtctggggtgacctcatgagcacacccgcatccttcatcacatgatggccccttccccagctccgggacccactcagacagggtgggggtgcgtggggcagtggacacgctctatctctccagtctacctggagggtgggcgccagtgctgtgccaccgtcagggcctccctctcagagagagggacacaacag

SEQ ID NO: 114242 - DNA, 3834 bp, Homo sapiens
  Payload ID: 2331
  Gene Symbol: CES3
  Gene Name: carboxylesterase 3
  Uniprot ID: Q6UWW8
  ENST ID: ENST00000303334
  CDS Start-End: 72-1787
gatcggtggtgctgaagggcagggatcttattccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctccca

SEQ ID NO: 114243 - DNA, 3817 bp, Homo sapiens
  Payload ID: 2331
  Gene Symbol: CES3
  Gene Name: carboxylesterase 3
  ENST ID: ENST00000394037
  CDS Start-End: 64-1770
gtgctgaagggcagggatcttattccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctccca

SEQ ID NO: 114244 - DNA, 3178 bp, Homo sapiens
  Payload ID: 2331
  Gene Symbol: CES3
  Gene Name: carboxylesterase 3
  Uniprot ID: Q6UWW8
  ENST ID: ENST00000543856
  CDS Start-End: 447-1079
gtgtgactctgtgccagagcaattgactaaaactctcaggttttagatatcaagccaccggggacttcatgagccaagtcccttccattcctttccaggtgcatagaacttcccacaagagtgtcagcactgtgctttcatcccgagcatcttgtttctgtcattcttattcttctacccatcttcacagcaatcattttcttcacttttctttttttttttttttcgtcttggcccattgcacaccctaagacaaagcaatccatttttgttgttgttgttgtttgtgtgtttgtttgttttttgagacagagcctcgatccatcatccaggctgcagtgcagcagcgccatcatgactctctactgcctcaacctctcaggcccgagcaatcctcccagcttcctgagtagctcgggcctcagggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgccc

SEQ ID NO: 114245 - DNA, 887 bp, Homo sapiens
  Payload ID: 2331
  Gene Symbol: CES3
  Gene Name: carboxylesterase 3
  ENST ID: ENST00000566453
  CDS Start-End: 51-173
gggatcttattccaccttctgaagcttctgtcgaaccagttgtaaggagaatggagagagcagtgagagtggagtccggggtcctggtcggggtggtctgtctgctcctggcatgccctgccacagccactggttaccaagatgctgtgtgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctca

SEQ ID NO: 114246 - DNA, 1826 bp, Homo sapiens
  Payload ID: 2331
  Gene Symbol: CES3
  Gene Name: carboxylesterase 3
  ENST ID: ENST00000570236
  CDS Start-End: 6-1145
ggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtcca

SEQ ID NO: 114247 - DNA, 1958 bp, Homo sapiens
  Payload ID: 2332
  Gene Symbol: CES4A
  Gene Name: carboxylesterase 4A
  ENST ID: ENST00000538199
  CDS Start-End: 1-1365
ggaaaacagatgcatgtggggaagacacccatccaagtctttttaggagtccccttctccagacctcctctaggtatcctcaggtttgcacctccagaacccccggagccctggaaaggaatcagagatgctaccacctacccgcctgggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttataatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattaga

SEQ ID NO: 114248 - DNA, 1472 bp, Homo sapiens
  Payload ID: 2332
  Gene Symbol: CES4A
  Gene Name: carboxylesterase 4A
  Uniprot ID: Q5XG92
  ENST ID: ENST00000535696
  CDS Start-End: 99-1223
ctcactgcggaccctggattgaaacgatctccccgcggccgccgccgctacctggtgcccgcaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgaggtggcggggccgcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatatcatgaagttcccgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtggga

SEQ ID NO: 114249 - DNA, 1825 bp, Homo sapiens
  Payload ID: 2332
  Gene Symbol: CES4A
  Gene Name: carboxylesterase 4A
  Uniprot ID: Q5XG92
  ENST ID: ENST00000540579
  CDS Start-End: 120-1511
ttttgctttgggttccgtcttctcactgcggaccctggattgaaacgatctccccgcggccgccgccgctacctggtgcccgcaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatatcatgaagttcccgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagatgccggcctccctgtctacctgtatgaatttgagcaccacgctcgtggaataatcgtcaaaccccgcactgatggggcagaccatggggatgagatgtacttcctctttgggggccccttcgccacaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaat

SEQ ID NO: 114250 - DNA, 2284 bp, Homo sapiens
  Payload ID: 2332
  Gene Symbol: CES4A
  Gene Name: carboxylesterase 4A
  Uniprot ID: Q5XG92
  ENST ID: ENST00000540947
  CDS Start-End: 185-1591
agagacaaggctgtgggctggtcagaagctggttacaattcctcccgccccagtacttgctggcagggattaagagcagataaaagtgtgctcacacactgtagacacggctaccatgccatccacagtgttgccatccacagtgttgccatcactcctgcccacagcaggagctggctggagcatgaggtggattctgtgctggagcctcaccctctgcctgatggcgcagacggccttgggtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctgggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatatcatgaagttcccgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagacctgaatttctccacctataaaa

SEQ ID NO: 114251 - DNA, 2178 bp, Homo sapiens
  Payload ID: 2332
  Gene Symbol: CES4A
  Gene Name: carboxylesterase 4A
  ENST ID: ENST00000535543
  CDS Start-End: 121-528
attttgctttgggttccgtcttctcactgcggaccctggattgaaacgatctccccgcggccgccgccgctacctggtgcccgcaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgaggtggcggggccggtaccctttgggaccgcagctgtggccagagcggcggggactggcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatatcatgaagttcccgctaaaccggcaggcgatgagaaaggaaaccatcactaagatgctctggagtacccgcaccctgttgaatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagatgccggcctccctgtctacctgtatgaatttgagcaccacgctcgtggaataatcgtcaaaccccgcactgatggggcagaccatggggatgagatgtacttcctctttgggggccccttcgccacaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattagacctgaatttctccacct

SEQ ID NO: 114252 - DNA, 2062 bp, Homo sapiens
  Payload ID: 2332
  Gene Symbol: CES4A
  Gene Name: carboxylesterase 4A
  ENST ID: ENST00000567587
  CDS Start-End: 1-533
gtgccttgcacaccaagaggcctcaagtggtcaccaaatatggaaccctgcaaggaaaacagatgcatgtggggaagacacccatccaagtctttttaggagtccccttctccagacctcctctaggtatcctcaggtttgcacctccagaacccccggagccctggaaaggaatcagagatgctaccacctacccgcctggatggagtctcgctctgtcgccaggctggagtgcagtggcacgatctcggctcactgcaacctccgcctcccgggttcaagcgagtctcctgcctcagcctctgagtatctggggctacaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttataatatcaccaaggagcaggtaccacttgtggtggaggagtacctggacaatgtcaatgagcatgactggaagatgctacgaaaccgtatgatggacatagttcaagatgccactttcgtgtatgccacactgcagactgctcactaccaccgagaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttatgggaggtcgacccagactgccactgcccctgtcactgcacccagcttggcatttaccatccatcctgctcaaccttgtgcctgtctgttcacattggcctggaggcctagggcaggttgtgacatggagcaaacttttggtagtttgggatcttctctcccacccacacttatctcccccagggccactccaaagtctatacacaggggtggtctcttcaataaagaagtgttgattaga

SEQ ID NO: 114253 - DNA, 2084 bp, Homo sapiens
  Payload ID: 2333
  Gene Symbol: CES5A
  Gene Name: carboxylesterase 5A
  Uniprot ID: Q6NT32
  ENST ID: ENST00000290567
  CDS Start-End: 123-1850
gctgcctctgcctgcctattcagcatttgcctgttaacaggaagctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggc

SEQ ID NO: 114254 - DNA, 2016 bp, Homo sapiens
  Payload ID: 2333
  Gene Symbol: CES5A
  Gene Name: carboxylesterase 5A
  Uniprot ID: Q6NT32
  ENST ID: ENST00000319165
  CDS Start-End: 150-1727
gttctgatgctgatcttcagtaactctgctgcctctgcctgcctattcagcatttgcctgttaacaggaagctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgt

SEQ ID NO: 114255 - DNA, 2092 bp, Homo sapiens
  Payload ID: 2333
  Gene Symbol: CES5A
  Gene Name: carboxylesterase 5A
  Uniprot ID: Q6NT32
  ENST ID: ENST00000518005
  CDS Start-End: 394-1803
aggaaactccaaactgttctccataatggctgtgctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtaagaccaggtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgt

SEQ ID NO: 114256 - DNA, 2258 bp, Homo sapiens
  Payload ID: 2333
  Gene Symbol: CES5A
  Gene Name: carboxylesterase 5A
  Uniprot ID: Q6NT32
  ENST ID: ENST00000521992
  CDS Start-End: 147-1961
agctggcaacggtagaggaaagtggtgaactcatttgacttttctttatcagctgtaccatgtacatgatgtgcaagaggactggggctctgtgtcaaggccagctgggatgctgaggttttgtgttaggaccaagggcaagtctgatggctgttctggtttgccctgcttcatgccatggcctaaaggagtttaggataagaaggggaatgtggagattgtgcctggtttactatttttatccagcctcctcaactttgtatgtattgaggattgatgtcttaaactacacttccaaagatgaggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgtaaaatagg

SEQ ID NO: 114257 - DNA, 1948 bp, Homo sapiens
  Payload ID: 2333
  Gene Symbol: CES5A
  Gene Name: carboxylesterase 5A
  ENST ID: ENST00000520435
  CDS Start-End: 79-1716
ctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctg

SEQ ID NO: 114258 - DNA, 574 bp, Homo sapiens
  Payload ID: 2333
  Gene Symbol: CES5A
  Gene Name: carboxylesterase 5A
  ENST ID: ENST00000536025
  CDS Start-End: 350-574
ctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggt

SEQ ID NO: 114259 - DNA, 1948 bp, Homo sapiens
  Payload ID: 2333
  Gene Symbol: CES5A
  Gene Name: carboxylesterase 5A
  ENST ID: ENST00000573522
  CDS Start-End: 79-1716
ctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctg

SEQ ID NO: 114260 - DNA, 2084 bp, Homo sapiens
  Payload ID: 2333
  Gene Symbol: CES5A
  Gene Name: carboxylesterase 5A
  ENST ID: ENST00000576219
  CDS Start-End: 123-1850
gctgcctctgcctgcctattcagcatttgcctgttaacaggaagctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggc

SEQ ID NO: 114261 - DNA, 574 bp, Homo sapiens
  Payload ID: 2333
  Gene Symbol: CES5A
  Gene Name: carboxylesterase 5A
  ENST ID: ENST00000574456
  CDS Start-End: 350-574
ctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggt

SEQ ID NO: 114262 - DNA, 2258 bp, Homo sapiens
  Payload ID: 2333
  Gene Symbol: CES5A
  Gene Name: carboxylesterase 5A
  ENST ID: ENST00000573178
  CDS Start-End: 147-1961
agctggcaacggtagaggaaagtggtgaactcatttgacttttctttatcagctgtaccatgtacatgatgtgcaagaggactggggctctgtgtcaaggccagctgggatgctgaggttttgtgttaggaccaagggcaagtctgatggctgttctggtttgccctgcttcatgccatggcctaaaggagtttaggataagaaggggaatgtggagattgtgcctggtttactatttttatccagcctcctcaactttgtatgtattgaggattgatgtcttaaactacacttccaaagatgaggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgtaaaatagg

SEQ ID NO: 114263 - DNA, 1669 bp, Homo sapiens
  Payload ID: 2333
  Gene Symbol: CES5A
  Gene Name: carboxylesterase 5A
  ENST ID: ENST00000576322
  CDS Start-End: 370-1437
ctgagtggcactgcacagggatggggaaaaaaggttggaccgcactgcagggactagaagatgcccctggcttccctctccccaaaaatgagagcccccaatggtggtagagagtttattctgttcaaagcatgttcttaccttttacttcattagatcttctcaacaatccaggaggtcaccaggggccattaactccattttatgggtgaggcaaaaagtccctggaggagaggggtcttgttcagagtcgtactgtcagctattgatggaaccaggactgggacccaagtcttcacaatacaatttcttagcccataagtaatacagagaggttgtcagatcccttgaagtctccttggacaggaaatggaagatgatttatcctggaggtcttggtcacttctctgcatggagatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctg

SEQ ID NO: 114264 - DNA, 2016 bp, Homo sapiens
  Payload ID: 2333
  Gene Symbol: CES5A
  Gene Name: carboxylesterase 5A
  ENST ID: ENST00000576682
  CDS Start-End: 150-1727
gttctgatgctgatcttcagtaactctgctgcctctgcctgcctattcagcatttgcctgttaacaggaagctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgt

SEQ ID NO: 114265 - DNA, 2092 bp, Homo sapiens
  Payload ID: 2333
  Gene Symbol: CES5A
  Gene Name: carboxylesterase 5A
  ENST ID: ENST00000572754
  CDS Start-End: 394-1803
aggaaactccaaactgttctccataatggctgtgctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtaagaccaggtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgt

SEQ ID NO: 114266 - DNA, 2188 bp, Homo sapiens
  Payload ID: 2333
  Gene Symbol: CES5A
  Gene Name: carboxylesterase 5A
  ENST ID: ENST00000521228
  CDS Start-End: 350-586
ctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacatatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcacgtgagtctctccaaatgatggacatcccagatccccaaagggcagcagtgcagtagccatagacagtgcccagcaacctaagaaggagcgagccttccgggacaatgaacaaaactggccctaattacttagcacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgtaaaatagg

SEQ ID NO: 114267 - DNA, 1669 bp, Homo sapiens
  Payload ID: 2333
  Gene Symbol: CES5A
  Gene Name: carboxylesterase 5A
  ENST ID: ENST00000541580
  CDS Start-End: 370-1437
ctgagtggcactgcacagggatggggaaaaaaggttggaccgcactgcagggactagaagatgcccctggcttccctctccccaaaaatgagagcccccaatggtggtagagagtttattctgttcaaagcatgttcttaccttttacttcattagatcttctcaacaatccaggaggtcaccaggggccattaactccattttatgggtgaggcaaaaagtccctggaggagaggggtcttgttcagagtcgtactgtcagctattgatggaaccaggactgggacccaagtcttcacaatacaatttcttagcccataagtaatacagagaggttgtcagatcccttgaagtctccttggacaggaaatggaagatgatttatcctggaggtcttggtcacttctctgcatggagatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccagcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctg

SEQ ID NO: 114268 - DNA, 2188 bp, Homo sapiens
  Payload ID: 2333
  Gene Symbol: CES5A
  Gene Name: carboxylesterase 5A
  ENST ID: ENST00000570713
  CDS Start-End: 350-586
ctaatttacattttcatcaacagtgtacgagggttctccgttttctgcactcttgccagcatccgttttttcctgtctttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcacgtgagtctctccaaatgatggacatcccagatccccaaagggcagcagtgcagtagccatagacagtgcccagcaacctaagaaggagcgagccttccgggacaatgaacaaaactggccctaattacttagcacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctgcagctggacttgaacatgagcctcggacagagactcaaagaaccgcgggtggagttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcctataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgtaaaatagg

SEQ ID NO: 114269 - DNA, 2335 bp, Homo sapiens
  Payload ID: 2334
  Gene Symbol: CMBL
  Gene Name: carboxymethylenebutenolidase homolog (Pseudomonas)
  Uniprot ID: Q96DG6
  ENST ID: ENST00000296658
  CDS Start-End: 422-1159
accccctctccctgcacctttctttatcttggagcctctcccatctctccctccctcttcctccctaccccaccctccgaccaccccacttcttcccctcccctcacacttccctccctcccttctctcgtctcctccccactgcgcctccctccctcctggccttccttcccttccccgactttgcagatttctcttcccccaggcctccctcctccacctctccgccccctccgggcttggctctcccaggaggctacgactggagccactggtcccgcaggatccccgcgtcctcggtcgccgcgtccacgtccctctcgcgtccccgcccggcgccacgccgcctcctctgggttcggcctccgcgcggtgcagcgcagtctcaggccgcgggacaagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacaaccattgttccagacttctttgtagggcaagagccttgggacccctctggcgactggtctatcttccctgagtggctgaaaacaagaaatgcccagaagatcgatagagagatcagtgctatcttgaagtatctgaaacaacagtgtcatgcccagaaaattggcatcgtgggattctgctggggtggaactgctgtccatcatttgatgatgaaatactcagaattcagggcaggggtgtccgtctatggcattgtcaaggattctgaagacatttacaatttaaagaaccccactttgttcatttttgctgaaaatgatgttgtgattccactcaaggacgtatctttgctgactcagaagttgaaagaacactgcaaagttgaatatcaaattaaaacattttctgggcagactcatgggttcgtgcatcggaagagagaagattgctcacctgcagacaagccctacattgacgaggccagaaggaatttaattgagtggctgaacaagtacatgtagcaagaatcaagggcaagccttcctagaatagctttcatcccaaaatttgcttggaaatagttagatcatttgatttaattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttgggaggccaaagtgggtggatcacctgaggtcaggagtttgagaccagcctggccaacatggtgagaccccatctctacaaaaaatacaaaaattagcctggtgtggtggtgcacgcctgtagtcccagctacttgggaggctgaggcacaagaatcaatagaacccaggaggtggagactgcagtgagccaagattgtgccactactgtactctagcctgggcagcagagtgagaccctgtctcaaaaataaataagtaaataaataaataaataaaataaaaaccaggtcagtacctggagaatttgaatgatagagaatgatagagtaataccctaattattagttaaaacctacaggccgggtgcggtggctcacgcctgtaatcccagcactttgggaggccgaggtgggtggatcacttgaggtcaggagttcaagaccagcctggccaacatggtgaaaccccatctctactaaaaatataaaaatcagccgggcatggtggcatgtgcctgtaatcccagctactcaggagtctgaggaggagaatcacttgaacctggaggcagaggttgcagtgagtcgaggttgcgctactgcactccagcctggacaacagagggagactctgtctcaaaaaaaaaaaaaaacctacagctgttcaaggaccagctgacaggtcaagtgtggccttttctggtctttgaacacatcatagaaagtgacaaatgctgcaaagccatgaagaacatgaactataaacgggtagactaactgcccagcttagacacttatctatgccacaaaacagctgaatttgtcacatttatatattgcaatatgggaagtattgagatcaaaacaggattccattgacctaattatattaagctaataaactaattttttgaatttttg

SEQ ID NO: 114270 - DNA, 1487 bp, Homo sapiens
  Payload ID: 2335
  Gene Symbol: CPA1
  Gene Name: carboxypeptidase A1 (pancreatic)
  Uniprot ID: P15085
  ENST ID: ENST00000011292
  CDS Start-End: 151-1410
agaactcccaccccagcctccccgtgggacaggacccaggtgctgggggagaacagacctcgggagcagccaggagtcctcggtcctgggagggtttaaaagccagggggccgtctcgacctcagtctgaccttccctcccggcagcagcatgcgggggttgctggtgttgagtgtcctgttgggggctgtctttggcaaggaggactttgtggggcatcaggtgctccgaatctctgtagccgatgaggcccaggtacagaaggtgaaggagctggaggacctggagcacctgcagctggacttctggcgggggcctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccagga

SEQ ID NO: 114271 - DNA, 1062 bp, Homo sapiens
  Payload ID: 2335
  Gene Symbol: CPA1
  Gene Name: carboxypeptidase A1 (pancreatic)
  ENST ID: ENST00000476062
  CDS Start-End: 255-1062
ctgggattgagatagtaacagcgtctagaagtttctaaagatggggagagaagaggcatcaggtgctccgaatctctgtagccgatgaggcccaggtacagaaggtgaaggagctggaggacctggagcacctgcagctggacttctggcgggggcctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaattt

SEQ ID NO: 114272 - DNA, 1303 bp, Homo sapiens
  Payload ID: 2335
  Gene Symbol: CPA1
  Gene Name: carboxypeptidase A1 (pancreatic)
  ENST ID: ENST00000484324
  CDS Start-End: 205-1200
cccaggcatcaggtgctccgaatctctgtagccgatgaggcccaggtacagaaggtgaaggagctggaggacctggagcacctgcagctggacttctggcgggggcctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaggaacagaatcctggggcttgcatgtgga

SEQ ID NO: 114273 - DNA, 581 bp, Homo sapiens
  Payload ID: 2335
  Gene Symbol: CPA1
  Gene Name: carboxypeptidase A1 (pancreatic)
  ENST ID: ENST00000481342
  CDS Start-End: 271-581
ttatcatggagggtgagagggtgtcagagctcagaactcccaccccagcctccccgtgggacaggacccaggcatcaggtgctccgaatctctgtagccgatgaggcccaggtacagaaggtgaaggagctggaggacctggagcacctgcagctggacttctggcgggggcctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtt

SEQ ID NO: 114274 - DNA, 573 bp, Homo sapiens
  Payload ID: 2335
  Gene Symbol: CPA1
  Gene Name: carboxypeptidase A1 (pancreatic)
  ENST ID: ENST00000604896
  CDS Start-End: 1-573
agtctgaccttccctcccggcagcagcatgcgggggttgctggtgttgagtgtcctgttgggggctgtctttggcaaggaggactttgtggggcatcaggtgctccgaatctctgtagccgatgaggcccaggtacagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagcc

SEQ ID NO: 114275 - DNA, 1366 bp, Homo sapiens
  Payload ID: 2336
  Gene Symbol: CPA2
  Gene Name: carboxypeptidase A2 (pancreatic)
  Uniprot ID: P48052
  ENST ID: ENST00000222481
  CDS Start-End: 56-1315
atccctacaaataaagttcaggaaggactctgaattctggactccaggaaaacccatggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagttcagcaccggaggagacaagccagctatctggctggatgctgggatccatgctcgagagtgggttacacaagctacggcactttggacagcaaataagattgtttctgattatggaaaggacccatccatcacttccattctggatgccctggatatcttcctcctgccagtcacaaaccctgatggatacgtgttctctcaaaccaaaaatcgtatgtggcggaagacccggtccaaggtatctggaagcctctgtgttggtgtggatcctaaccggaactgggatgcaggttttggaggacctggagccagcagcaacccttgctctgattcataccacggacccagtgccaactctgaagttgaagtgaaatccatagtggacttcatcaagagtcatggaaaagtcaaggccttcattaccctccacagctattcccagctgctgatgttcccctatgggtacaaatgtaccaagttagatgactttgatgagctgagtgaagtggcccaaaaggctgcccaatctctgagaagcctgcatggcaccaagtacaaagtgggaccaatctgctctgtcatctaccaagccagtggaggaagcattgactggtcctatgattatggcatcaagtactcatttgcctttgaactgagagacacagggcgctacggcttcctcttgccagcccgtcagatcctgcccacagccgaggagacctggcttggcttgaaggcaatcatggagcatgtgcgagaccacccctattagggccctggggaagaaacaagagccattaaaatctctttggtttgaagcaaa

SEQ ID NO: 114276 - DNA, 803 bp, Homo sapiens
  Payload ID: 2336
  Gene Symbol: CPA2
  Gene Name: carboxypeptidase A2 (pancreatic)
  ENST ID: ENST00000416698
  CDS Start-End: 8-556
catggccatgaggttgatcctgttttttggtgccctttttgggcatatctactgtctagaaacatttgtgggagaccaagttcttgagattgtaccaagcaatgaagaacaaattaaaaatctgctacaattggaggctcaagaacatctccagcttgatttttggaaatcacccaccaccccaggggagacagcccacgtccgagttcccttcgtcaacgtccaggcagtcaaagtgttcttggagtcccagggaattgcctattccatcatgattgaagacgtgcaggtcctgttggacaaagagaatgaagaaatgctttttaataggagaagagaacggagtggtaacttcaattttggggcctaccataccctggaagagatttcccaagaaatggataacctcgtggctgagcaccctggtctagtgagcaaagtgaatattggctcttcttttgagaaccggcctatgaacgtgctcaagaagagttctggtcgtatgcagaaggatgatggacaactaaaccctaaaccgcaaagacaaacgccctgaacgaagatcttttgaaaaaggatatagatgaaaaaagttcagcaccggaggagacaagccagctatctggctggatgctgggatccatgctcgagagtgggttacacaagctacggcactttggacagcaaataagattgtttctgattatggaaaggacccatccatcacttccattctggatgccctggatatcttcctcctgccagtcacaaaccctgatggatacgtgttctctcaaaccaaa

SEQ ID NO: 114277 - DNA, 1795 bp, Homo sapiens
  Payload ID: 2337
  Gene Symbol: CPA3
  Gene Name: carboxypeptidase A3 (mast cell)
  Uniprot ID: P15088
  ENST ID: ENST00000296046
  CDS Start-End: 53-1306
agggctgaggcataaaactgccagagggtctcaaggcaggcaaagaagaaccatgaggctcatcctgcctgtgggtttgattgctaccactcttgcaattgctcctgtccgctttgacagggagaaggtgttccgcgtgaagccccaggatgaaaaacaagcagacatcataaaggacttggccaaaaccaatgagcttgacttctggtatccaggtgccacccaccacgtagctgctaatatgatggtggatttccgagttagtgagaaggaatcccaagccatccagtctgccttggatcaaaataaaatgcactatgaaatcttgattcatgatctacaagaagagattgagaaacagtttgatgttaaagaagatatcccaggcaggcacagctacgcaaaatacaataattgggaaaagattgtggcttggactgaaaagatgatggataagtatcctgaaatggtctctcgtattaaaattggatctactgttgaagataatccactatatgttctgaagattggggaaaagaatgaaagaagaaaggctatttttacggattgtggcattcacgcacgagaatgggtctccccagcattctgccagtggtttgtctatcaggcaaccaaaacttatgggagaaacaaaattatgaccaaactcttggaccgaatgaatttttacattcttcctgtgttcaatgttgatggatatatttggtcatggacaaagaaccgcatgtggagaaaaaatcgttccaagaaccaaaactccaaatgcatcggcactgacctcaacaggaattttaatgcttcatggaactccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggccaaagttgcaaagattggcactgatgttctatcaactcgatatgaaacccgctacatctatggcccaatagaatcaacaatttacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccttcagtttctcacagattttcaccatgtggcttcatcaatttatgtgctaatacaataaaataaaatgcacttaatgctttaaaattcatctttttatgataaactatattctctgtatttctctatagcattaataatcaatattaatgccattcattcagtctgttaataagaaataatatcttcaattttc

SEQ ID NO: 114278 - DNA, 2797 bp, Homo sapiens
  Payload ID: 2338
  Gene Symbol: CPA4
  Gene Name: carboxypeptidase A4
  Uniprot ID: Q9UI42
  ENST ID: ENST00000222482
  CDS Start-End: 29-1294
gccactgtatgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcagtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgtttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttttgtttttgtttttttgcttttaccaaacatgtctgtaaatcttaacctcctgcctaggatttgtacagcatctggtgtgtgcttataagccaataaatattcaatgtgagtttc

SEQ ID NO: 114279 - DNA, 2718 bp, Homo sapiens
  Payload ID: 2338
  Gene Symbol: CPA4
  Gene Name: carboxypeptidase A4
  Uniprot ID: Q9UI42
  ENST ID: ENST00000445470
  CDS Start-End: 48-1214
ataaatacagcttgactcagccactgtatgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcagatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcagtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgtttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttttgtttttgtttttttgcttttaccaaacatgtctgtaaatcttaacctcctgcctaggatttgtacagcatctggtgtgtgcttataagccaataaatattcaatgtgagtttca

SEQ ID NO: 114280 - DNA, 535 bp, Homo sapiens
  Payload ID: 2338
  Gene Symbol: CPA4
  Gene Name: carboxypeptidase A4
  ENST ID: ENST00000492072
  CDS Start-End: 21-535
atgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagattgtatctgattaccagagggatccagc

SEQ ID NO: 114281 - DNA, 568 bp, Homo sapiens
  Payload ID: 2338
  Gene Symbol: CPA4
  Gene Name: carboxypeptidase A4
  ENST ID: ENST00000486598
  CDS Start-End: 482-568
atttcagaaatatgggagccaaatggaactgaaaatgaatggctgataatagctcacatggaggaagaagacctgggctcttgttccagctttgcccctgtgtcatcctggacaagtccactctcttctctgagaccccatttcatctgtgaaatcaggactagatgatcattgcagtctctccccagctccctcatctcctgccagttctttttctgcctagttcttacttataagggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatg

SEQ ID NO: 114282 - DNA, 551 bp, Homo sapiens
  Payload ID: 2338
  Gene Symbol: CPA4
  Gene Name: carboxypeptidase A4
  ENST ID: ENST00000473956
  CDS Start-End: 19-551
gactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcagatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccat

SEQ ID NO: 114283 - DNA, 1512 bp, Homo sapiens
  Payload ID: 2338
  Gene Symbol: CPA4
  Gene Name: carboxypeptidase A4
  ENST ID: ENST00000493259
  CDS Start-End: 114-1067
gactgactccccggggacatgaggtggatactgttcattggggcccttattgggtccagcatctgtggccaagaaaaattttttgggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcatatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcagtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgta

SEQ ID NO: 114284 - DNA, 1444 bp, Homo sapiens
  Payload ID: 2339
  Gene Symbol: CPA5
  Gene Name: carboxypeptidase A5
  Uniprot ID: Q8WXQ8
  ENST ID: ENST00000393213
  CDS Start-End: 1-1311
atgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 114285 - DNA, 1803 bp, Homo sapiens
  Payload ID: 2339
  Gene Symbol: CPA5
  Gene Name: carboxypeptidase A5
  Uniprot ID: Q8WXQ8
  ENST ID: ENST00000431780
  CDS Start-End: 446-1657
ctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacagg

SEQ ID NO: 114286 - DNA, 1940 bp, Homo sapiens
  Payload ID: 2339
  Gene Symbol: CPA5
  Gene Name: carboxypeptidase A5
  Uniprot ID: Q8WXQ8
  ENST ID: ENST00000474905
  CDS Start-End: 497-1807
tctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 114287 - DNA, 390 bp, Homo sapiens
  Payload ID: 2339
  Gene Symbol: CPA5
  Gene Name: carboxypeptidase A5
  ENST ID: ENST00000479492
  CDS Start-End: 1-257
agtccatcagacctggaatcttctgcatcggcgtggatctcaacaggaactggaagtcgggttttggagatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 114288 - DNA, 1794 bp, Homo sapiens
  Payload ID: 2339
  Gene Symbol: CPA5
  Gene Name: carboxypeptidase A5
  Uniprot ID: Q8WXQ8
  ENST ID: ENST00000461828
  CDS Start-End: 484-1794
aactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactag

SEQ ID NO: 114289 - DNA, 552 bp, Homo sapiens
  Payload ID: 2339
  Gene Symbol: CPA5
  Gene Name: carboxypeptidase A5
  ENST ID: ENST00000497503
  CDS Start-End: 528-552
aactgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgagcctctaggtgctgtgctgtcctgaggcctgggccatggtgcccaaggaaagcccctgaagctcaccaggaggaagaagcatgcagggcacccctggaggcggga

SEQ ID NO: 114290 - DNA, 2099 bp, Homo sapiens
  Payload ID: 2339
  Gene Symbol: CPA5
  Gene Name: carboxypeptidase A5
  Uniprot ID: Q8WXQ8
  ENST ID: ENST00000466363
  CDS Start-End: 656-1966
ctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggtgggtgggggagcagggcgttctgtcgataaacgagctcccttctttgcacacatagccagttaatcggccattctgagatagtttggatggggagggggagcttctgagaatcgccagtgacagctttaccaagccaattcactcaagttgtctcatctataccccttcaaaccctgtgaggtagggaggggagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 114291 - DNA, 562 bp, Homo sapiens
  Payload ID: 2339
  Gene Symbol: CPA5
  Gene Name: carboxypeptidase A5
  ENST ID: ENST00000494311
  CDS Start-End: 467-562
tgcttctctctctctcttttactcttattctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttg

SEQ ID NO: 114292 - DNA, 592 bp, Homo sapiens
  Payload ID: 2339
  Gene Symbol: CPA5
  Gene Name: carboxypeptidase A5
  ENST ID: ENST00000463587
  CDS Start-End: 223-592
aactgcttctctctctctcttttactcttattctttctctctcactctctctcttttcccacccttaagccaagtacagggatagttgtctcatcattggtggcttaaaatgatgtttttgaacaagaagacgccccatgggtacttttggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaat

SEQ ID NO: 114293 - DNA, 2573 bp, Homo sapiens
  Payload ID: 2339
  Gene Symbol: CPA5
  Gene Name: carboxypeptidase A5
  Uniprot ID: Q8WXQ8
  ENST ID: ENST00000485477
  CDS Start-End: 1130-2440
tctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggtgggtgggggagcagggcgttctgtcgataaacgagctcccttctttgcacacatagccagttaatcggccattctgagatagtttggatggggagggggagcttctgagaatcgccagtgacagttaagtggcctattgttgacgtcctctgctgaacgacttggttggattcagcttctgccttacccccaccccctgtggattttctgttagattcatcatttgccattcaggcatcatctttcactttctccttccaacatgactgctttgtgtgctggcccctgctttactcctgctattcccaaactataaagggaactgtgtggggcttcagcaggactgagaaattgactctgctgtctgttgagaactctaataatgactgcggtgaccttcatgtctagcagaaaacccactgtctgtgctagcacaatgatgaccacctgaagacagagaaaagggaatcttgattgaattccttctcatacaatatatagttatttcctttgttctcctctccattctcttctcttccccttctccccatcgccactggaggactgatctcaaatgcagctgtgactaaaagttaatgccttttgaataataatacattgcattttgcaggctttaccaagccaattcactcaagttgtctcatctataccccttcaaaccctgtgagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggtgctgctggatgaggaaagacaggccatggcgaaatcccgccggctggagcgcagcaccaacagcttcagttactcatcataccacaccctggaggagatatatagctggattgacaactttgtaatggagcattccgatattgtctcaaaaattcagattggcaacagctttgaaaaccagtccattcttgtcctgaagttcagcactggaggttctcggcacccagccatctggattgacactggaattcactcccgggagtggatcacccatgccaccggcatctggactgccaataagattgtcagtgattatggcaaagaccgtgtcctgacagacatactgaatgccatggacatcttcatagagctcgtcacaaaccctgatgggtttgcttttacccacagcatgaaccgcttatggcggaagaacaagtccatcagacctggaatcttctgcatcggcgtggatctcaacaggaactggaagtcgggttttggaggaaatggttctaacagcaacccctgctcagaaacttatcacgggccctcccctcagtcggagccggaggtggctgccatagtgaacttcatcacagcccatggcaacttcaaggctctgatctccatccacagctactctcagatgcttatgtacccttacggccgattgctggagcccgtttcaaatcagagggagttgtacgatcttgccaaggatgcggtggaggccttgtataaggtccatgggatcgagtacatttttggcagcatcagcaccaccctctatgtggccagtgggatcaccgtcgactgggcctatgacagtggcatcaagtacgccttcagctttgagctccgggacactgggcagtatggcttcctgctgccggccacacagatcatccccacggcccaggagacgtggatggcgcttcggaccatcatggagcacaccctgaatcacccctactagcagcacgactgagggcaggaggctccatccttctccccaaggtctgtggctcctcccgaaacccaagttatgcatccccatccccatgccctcatcccgacctcttagaaaataaatacaagtttgaacaggc

SEQ ID NO: 114294 - DNA, 1861 bp, Homo sapiens
  Payload ID: 2340
  Gene Symbol: CPA6
  Gene Name: carboxypeptidase A6
  Uniprot ID: Q8N4T0
  ENST ID: ENST00000297770
  CDS Start-End: 217-1530
cccaagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatctctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtgatgaaggagcttctatgcacccttgtgatgacacatactgtggcccttttccagaatctgagccggaagtgaaggctgtagctaacttccttcgaaaacacagaaagcacattagggcttatctctcctttcatgcatatgctcagatgttactgtatccctattcttacaaatatgcaacaattcccaattttagatgtgtggaatctgcagcttataaagctgtgaatgcacttcagtcagtatacggggtacgatacagatatggaccagcctccacaacgttgtatgtgagctctggtagctcaatggattgggcctacaaaaatggaataccttatgcatttgctttcgaactacgtgacactggatattttggatttttactcccagagatgctcatcaaacccacctgtacagaaactatgctggctgtgaaaaatatcacaatgcacctgctaaagaaatgtccctgagacagcccaaggctcaggtcaactgccataggattctgagcaaggcctacttggccctggatagaaattgttttcaaagagaagggcagctgcttagagtgaacatgtctatggactttaaaaagaccccacgcaatttgactttgtggcaatagaaaacagtaaaaaacagggcatagcctagtttgttataagaaaaagcatccattttctatccttttagagtcttatttgattatggtgggagggaatgttttcaaatttcccatttctcaagaaatgttcatattaattgaggatttcccttcaataaatctcatgtcctcaatta

SEQ ID NO: 114295 - DNA, 1494 bp, Homo sapiens
  Payload ID: 2340
  Gene Symbol: CPA6
  Gene Name: carboxypeptidase A6
  ENST ID: ENST00000479862
  CDS Start-End: 215-493
caagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaagggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatctctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtgatgtgagctctggtagctcaatggattgggcctacaaaaatggaataccttatgcatttgctttcgaactacgtgacactggatattttggatttttactcccagagatgctcatcaaacccacctgtacagaaactatgctggctgtgaaaaatatcacaatgcacctgctaaagaaatgtccctgagacagcccaaggctcaggtcaactgccataggattctgagcaaggcctacttggccctggatagaaattgttttcaaagagaagggcagctgcttagagtgaacatgtctatggactttaaaaagaccccacgcaatttgactttgtggcaatagaaaacagtaaaaaacagggcatagcctagtttgttataagaaaaagcatccattttctatccttttagagtcttatttgattatggtgggagggaatgttttcaaatttcccatttctcaagaaatgttcatattaattgaggatttcccttcaataaatctcatgtcctcaattaggatctaggctagtaatgatgtttaattacttggttctcattggaaat

SEQ ID NO: 114296 - DNA, 1538 bp, Homo sapiens
  Payload ID: 2340
  Gene Symbol: CPA6
  Gene Name: carboxypeptidase A6
  Uniprot ID: Q8N4T0
  ENST ID: ENST00000518549
  CDS Start-End: 215-1162
caagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatctctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtggtaagtttgggaccaactgggatccagatccaaaggtttctgcaggttttactctgcaaaatatgagtccagaggactctcatgggagactcatgtttttctgtatgtgaaaacctggtagagaaaggtacagatacgtacatgatagctgtaattggcaaaagaaaatgaaaggattcttttttaatatataaaaatcaaggattttaaatatgtcaattcggtcctgaaaactgaaaatttaaatacatatgtaaaagcagcaaactgaggaatatttgtcattccccaaattaaaacatgaaccgtggtgtagtataattctggttaaatctttttatccttttcatacaagcaccactgatgctgcattcggctgtctgtcgtggtcagagctgtcatgaccttgtctatattctaccactctgctggtcatacgtggattgaccatgcacattgggaatgtatttctgctgcattccatgt

SEQ ID NO: 114297 - DNA, 1458 bp, Homo sapiens
  Payload ID: 2341
  Gene Symbol: CPB1
  Gene Name: carboxypeptidase B1 (tissue)
  Uniprot ID: P15086
  ENST ID: ENST00000282957
  CDS Start-End: 24-1277
cccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattgg

SEQ ID NO: 114298 - DNA, 584 bp, Homo sapiens
  Payload ID: 2341
  Gene Symbol: CPB1
  Gene Name: carboxypeptidase B1 (tissue)
  ENST ID: ENST00000462345
  CDS Start-End: 287-584
gatatcacaatgatatggtttggctgtgtcccctctgagaagagggctaccatcttccagttaaattggactttaactagaagtccaattaaacctctttttgttcctagtttcaggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatg

SEQ ID NO: 114299 - DNA, 1773 bp, Homo sapiens
  Payload ID: 2341
  Gene Symbol: CPB1
  Gene Name: carboxypeptidase B1 (tissue)
  Uniprot ID: P15086
  ENST ID: ENST00000491148
  CDS Start-End: 335-1588
aaagtctccagaatgaggaaatgttggaagcaaataatatattcagctgagcattcttcctggcagtgggagcaggagcctgatttggaccttaaaagcttagtggcaacaacaaataagcattggcctggaaaatccacatcccaacaggctaaacaaggcaggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgaatgccctggctaaagctactgtgaaagaacttgcctcactgcacggcaccaagtacacatatggcccgggagctacaacaatctatcctgctgctgggggctctgacgactgggcttatgaccaaggaatcagatattccttcacctttgaacttcgagatacaggcagatatggctttctccttccagaatcccagatccgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaa

SEQ ID NO: 114300 - DNA, 585 bp, Homo sapiens
  Payload ID: 2341
  Gene Symbol: CPB1
  Gene Name: carboxypeptidase B1 (tissue)
  ENST ID: ENST00000494888
  CDS Start-End: 408-585
gcactccagcctgggcgacagagcgagactcctactcaaaaaaaaaaagacttcaaagcaaatacagaaagttacatagttgcaggaaacaacaacaacaacaacaactttgctcttttaatacaaaggactcagttgtcttaagtaatcaaagacctaataatagaaaacataaagcacagaaaattattttgataagacacaaaatctttgttttctagtcagagccctctaaaggtgttgagagagataccctctcagactttacacagctaccaaggcaacaatgccaggaaaactattaatcaagatatgatagttcctgtttgcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacac

SEQ ID NO: 114301 - DNA, 614 bp, Homo sapiens
  Payload ID: 2341
  Gene Symbol: CPB1
  Gene Name: carboxypeptidase B1 (tissue)
  ENST ID: ENST00000468341
  CDS Start-End: 5-614
cacaatgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgct

SEQ ID NO: 114302 - DNA, 1717 bp, Homo sapiens
  Payload ID: 2342
  Gene Symbol: CPB2
  Gene Name: carboxypeptidase B2 (plasma)
  Uniprot ID: Q96IY4
  ENST ID: ENST00000181383
  CDS Start-End: 18-1289
agaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagatgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccagtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaattagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcaaattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaagtttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaatacaa

SEQ ID NO: 114303 - DNA, 1655 bp, Homo sapiens
  Payload ID: 2342
  Gene Symbol: CPB2
  Gene Name: carboxypeptidase B2 (plasma)
  ENST ID: ENST00000439329
  CDS Start-End: 68-1228
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagatgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccataatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaattagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcaaattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaagtttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgcctttagaaataca

SEQ ID NO: 114304 - DNA, 9394 bp, Homo sapiens
  Payload ID: 2343
  Gene Symbol: CPD
  Gene Name: carboxypeptidase D
  Uniprot ID: O75976
  ENST ID: ENST00000225719
  CDS Start-End: 77-4219
ggggatccggcgggcccccgccgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacgatgtttgtctttctttgtgttttgtctcataatcttttttcagatgcaatatgccggaaaaagttataggtccagtttgaaaattatttagtttttctgcctatgctagtggaaaaatagtaccaggatcagaatacagggtatcacctatggaatgtttctgtatttatgaattgactcaaaagaaagctttgtttctgaaatcgcattatgtagtagccacagttttctgtttgtagctcagctagattgttatatatgttcaatcatttcacaataacaacacaaaactggtcattgaaaggtttttatgtacgcattttaaacttgttcgttaaaaatttggtcctttttccaggtgaggcccagttagaataatgtgtcccggcacttttaggcacagcaaggatgaattcaatatccccttttcacttagcaacaatgtgttacttctaccctaataggaattgggaaagcaaagttgtatgagaaacagactctgctgataaagtactcatagtccagaccagagaaatataaatggaaataggttatatttcaatagtgattggttcatctaaaagtctctgctgtaaaggaaataaagcatagaggtttgagcatggactttggagttggaccaatctgtgactgattcttcgttctgctacttgcttccaatgtgaccttgtacaagtttcttgacattctctgagcctcagtttctctactggttgaataatccttgataggattgcagtggaaaattaaatgaaataatgttagcaaaggtcccaacataatatttgacttggaattgaatgcccatggtaaccagcatcattttccttcatgtgatgtcttcttatgcctttgaaagaaagttactttatcaaatgtataaataaagatctgtttataggtgatctttttaatttagaagaaattctgagacacaaataaaaaaagaaattttttattatgtggttcaatagattgtctaaagcatggcagtaaagttttaattatgccaagatgcttcatatttgtttttaaatgaaattaagttgtatttatgcttctttagtgaaaacaacgttacttaactgctacaggaagtgtgaatagtgataacagttctttttctctcagtgtttgaaatattttcctgaattttcttagttttctcatacctgaatcaagaacccttttggtttgtttcataaacagtaatctagttattatgttcagcttttcagatttataatagctgattgttctcagcaaattaaacatgatggtcaacgctaa

SEQ ID NO: 114305 - DNA, 4007 bp, Homo sapiens
  Payload ID: 2343
  Gene Symbol: CPD
  Gene Name: carboxypeptidase D
  Uniprot ID: O75976
  ENST ID: ENST00000543464
  CDS Start-End: 403-3804
agtgtggctgggacttagaattaggcaatctgattcccgatagtcctcttagccacggagggacactggagcccaaaaatggcagatgatattcccaggatcttccccttgcctatttgacagaagctgatttttctccaatttttacctctgactcagcttaagaagatatggacttagctggagaacttgcacagatctgtgagccgcttcattttagactctgaagggtttgtgatgtcatttgtgcaccttattagcctgggcagaatggctaatggtcacacttctaatacacactttaagtgttattaagcattgcatgaggtttaaaaaattacaaagtagaagaaggaggacctcaagaaattagtataaaacaagagaatgttataaatatttatgaggtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggttctttggtggttaactacccttttgatgatgatgaacaaggacttgccacatatagtaaatcaccagatgatgctgtgttccaacaaatagcactttcttattccaaggaaaattcccagatgtttcaaggtagaccttgcaagaatatgtatcctaatgaatattttcctcatggaataacaaatggagctagttggtataatgtgccaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaattggttgacaggactaggattgtgattgtcccttctctaaatccagatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcagatgagaatattccaggaggagtaatgcgtggagcagaatggcatagtcacctgggcagcatgaaggattatagtgtcacctatggccattgtccggaaatcacagtatacacaagctgctgttactttcctagtgctgcacgactcccttccttgtgggcagacaataagagatctcttcttagtatgttagtggaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtctttgtgcatcatgatgcagctagttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaa

SEQ ID NO: 114306 - DNA, 680 bp, Homo sapiens
  Payload ID: 2343
  Gene Symbol: CPD
  Gene Name: carboxypeptidase D
  ENST ID: ENST00000584221
  CDS Start-End: 1-555
gttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaatttgggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataa

SEQ ID NO: 114307 - DNA, 672 bp, Homo sapiens
  Payload ID: 2343
  Gene Symbol: CPD
  Gene Name: carboxypeptidase D
  ENST ID: ENST00000579502
  CDS Start-End: 1-249
aatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatggttctgtggtgatagtctttgacacagataaccggatatttggtttgccaagggagcttgtggtaactgtatcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgt

SEQ ID NO: 114308 - DNA, 394 bp, Homo sapiens
  Payload ID: 2343
  Gene Symbol: CPD
  Gene Name: carboxypeptidase D
  ENST ID: ENST00000584050
  CDS Start-End: 1-121
agttggaactgaactgcttttggctctggcagaatttctctgcctgaactacaaaaagaacccagctgttacccaaatgggcgagagagagctcaagagaaagactgtacttcaaaaataggacaaacaaatgctcgtggcaaagatttggatacagacttcacaaataatgcctcccaacctgagaccaaagccatcattgaaaatttgattcaaaaacaggactttagtctttctgttgccttagatggtggttccatgctggtcacatatccttatgacaagccagtacagacagtggaaaataaagagactctgaagcatttggcatctctttatgcaaataatcatccatccatgcacatgggtcagcccagttgcccaaataaatcag

SEQ ID NO: 114309 - DNA, 2421 bp, Homo sapiens
  Payload ID: 2344
  Gene Symbol: CPE
  Gene Name: carboxypeptidase E
  Uniprot ID: P16870
  ENST ID: ENST00000402744
  CDS Start-End: 281-1711
gcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatcccc

SEQ ID NO: 114310 - DNA, 633 bp, Homo sapiens
  Payload ID: 2344
  Gene Symbol: CPE
  Gene Name: carboxypeptidase E
  ENST ID: ENST00000431967
  CDS Start-End: 192-633
ataaatagatataattaatgaaaatgttaatagtgccggtctccagaatatctctagatcactgaccttctgattggtggaaaaacctttggagaatgatctttacaggattccatggcagtgagttaatctatttttctctacatgggggcagcagacgaggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatg

SEQ ID NO: 114311 - DNA, 563 bp, Homo sapiens
  Payload ID: 2344
  Gene Symbol: CPE
  Gene Name: carboxypeptidase E
  ENST ID: ENST00000511992
  CDS Start-End: 93-563
gagacacaagagtgggaagagtgcagattggagcagctatccaaaaatacagaaggccagaaggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatac

SEQ ID NO: 114312 - DNA, 564 bp, Homo sapiens
  Payload ID: 2344
  Gene Symbol: CPE
  Gene Name: carboxypeptidase E
  ENST ID: ENST00000513982
  CDS Start-End: 148-564
atatgataaatagtacctggagcgcctacttcacaagaaagcctgagagagtccagttgtactcaaggagagggagaagtagccaggagacagatccggtaggactgtgaaagccatggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagac

SEQ ID NO: 114313 - DNA, 437 bp, Homo sapiens
  Payload ID: 2344
  Gene Symbol: CPE
  Gene Name: carboxypeptidase E
  ENST ID: ENST00000480404
  CDS Start-End: 1-326
tcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctgattgcaagctgtatgaagtggggaccctgattccagcacccagctcatgtttggcacacagcgggcttgaatatacattatgaaataatctacattatggaaaaatactgaatatgcagtgtggaaaaaatgaatccatcaatagctgcataacacagtgtattaaaataaaatgttttattcttcatacattc

SEQ ID NO: 114314 - DNA, 6636 bp, Homo sapiens
  Payload ID: 2345
  Gene Symbol: CPM
  Gene Name: carboxypeptidase M
  Uniprot ID: P14384
  ENST ID: ENST00000338356
  CDS Start-End: 48-1379
ccctcatgtgttctcaggttcttcttatttttattcatctctagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttggttattactttcaattgaaagttctatgggatctagaaatgagacatactggcatggagagtgagaacgacaaaggaatgaagagctacaggagcatttaggccatttctatgccaagcttattctacatgcacaaaatcatacatgttaataaatataaacaaattggaggcttatttaaaccaattatgaaatctggtaatttgtgcagcagcaatagatgataaccaaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatggtatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaaaaaaagaaaaaagaaagaaagaaaaaaggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatctgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccat

SEQ ID NO: 114315 - DNA, 703 bp, Homo sapiens
  Payload ID: 2345
  Gene Symbol: CPM
  Gene Name: carboxypeptidase M
  ENST ID: ENST00000551728
  CDS Start-End: 65-259
gctataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaat

SEQ ID NO: 114316 - DNA, 794 bp, Homo sapiens
  Payload ID: 2345
  Gene Symbol: CPM
  Gene Name: carboxypeptidase M
  ENST ID: ENST00000548954
  CDS Start-End: 47-794
gctataacacccggccccgccgggcggccgcgggtgggtagagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttccta

SEQ ID NO: 114317 - DNA, 697 bp, Homo sapiens
  Payload ID: 2345
  Gene Symbol: CPM
  Gene Name: carboxypeptidase M
  ENST ID: ENST00000546556
  CDS Start-End: 1-108
tcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaagctgcgttcctttgcctgcaacaggggtcaagatgagttttgcctgacttctttgatgtcctgaactttccgtagtcctttttcttgaatttgttcattataaatatagcttggcatttgtttgatcttttcaa

SEQ ID NO: 114318 - DNA, 2116 bp, Homo sapiens
  Payload ID: 2345
  Gene Symbol: CPM
  Gene Name: carboxypeptidase M
  Uniprot ID: P14384
  ENST ID: ENST00000546373
  CDS Start-End: 105-1436
gtctagattcttcttggcctctctgagcagcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctc

SEQ ID NO: 114319 - DNA, 655 bp, Homo sapiens
  Payload ID: 2345
  Gene Symbol: CPM
  Gene Name: carboxypeptidase M
  ENST ID: ENST00000551897
  CDS Start-End: 1-596
acccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaagctgcgttcctttgcctgcaacaggggtcaagatgagttttgcctgacttctttgatgtcctgaactttccgtagtcctttttcttgaatttgttcattataaatatagcttggcatttgttt

SEQ ID NO: 114320 - DNA, 243 bp, Homo sapiens
  Payload ID: 2345
  Gene Symbol: CPM
  Gene Name: carboxypeptidase M
  ENST ID: ENST00000549781
  CDS Start-End: 26-243
agaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaagaaacctgtgggttcttgttgtggggcggtttccaaaggaacacagaattgggattcca

SEQ ID NO: 114321 - DNA, 6655 bp, Homo sapiens
  Payload ID: 2345
  Gene Symbol: CPM
  Gene Name: carboxypeptidase M
  Uniprot ID: P14384
  ENST ID: ENST00000551568
  CDS Start-End: 62-1393
ataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatataataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaaatgcctgcaaaaagaagatcattttgtatacagagaaccggatgaatataagcaatgaagatgaacatttattgatcttctacatacaagacttcaccataaggccaggagcagtggctcacaccttgtaatcccagcactttgggaggccaaggtgggcggatcaccctgaggttaggagttcaaaaccagcctgaccaacatggtgaaaccctgtctctactaaatattagcggggtgtggtggcgggcacctgtaatcgcagcctttcaggaggctgagacaggagaatcgcttgaaccctagaggcggagtttgcagtgagccgagatagtgccattgtactccagcttgggcaacagagtaagactctgtctcaaaaaaaaaaaaacaaaaacaaacaaacaaaaaaaacacctcaccatgagtgctacatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatactcatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctactaaaaaaaaaaaaaaaattagtcgggcgtggtggtgcatgcctgtaatcccagctactggggaggctgaggcaggagaatcgcttgaacctgggaggcagaggttgcagtgagccgggattgcgccattgtactccagcctgggtgaagaagtgagactctgtcttaaaaaaaaaaattggtgctgataaatattgatgaattctgctctctgctctctatggttgtcaacactgcagagttgaggcctcatatctcacctgcactgctgcaacagcttactggtcccttgctcccagccttctcctcttcagtccatcgtccacacagcactggggaaggggagccacttgaaacaaaagtcaacaactggttgtagttcataaacacagagctgtttgtgtcccctgtatctggaatgccattatgacccactacattttttctttcctacccctcttaaaactcagttcaggtagcagctccactaggaagccttggctgaccataatcccattcaattccatttcacctcttcgcaggcagtctggggttagggaccctttctctttgctccccaaaataaactggttatctctactattggatttacaacattgtattataatcttctccatgtgtgccttctctagtagaatgtgagctctttgaggccaaggtctatttaatttgtttgaaaaattcattgttatatcctcaaagcctagcacatagtaggtactgaatgaatgaatgaacaaggggtgccaggagactgctactcccagtccttcccagaaactgcctagggctttgagtcattttatgaagctaggtcttaatgcgtaggcaacctcccagctcactatgaacgctgacagaagagtgttttcatgtctataatcaagaattccagatacattccttttactgaaccttgaattgatcctaagattggtagtaaaggtattatgttacctcctaacagcactacaaagtacctttttttatcagaaaaaaattttaccattaggactcaatttgaagtactaatgcttctcaagttctccactatgagagttaccctgtattagaccgttacctataagaattaaggggtaaagcactaaacagaaaagaaaaaaaaaatagcaactctggtgagcagatttctttcctttcttccttccttctcctcttcctaccttcctccctcctttccctctcctccccttctctccctttccctccccttcccttccttttcttctttcctccgctcccctccccttccctccccttcccatccttctttctcttttttttacttaatccccagtgtgacagtaatataggctgatttctagaagtgtggtgtattactcatggaaagtgagttgccttggttattactttcaattgaaagttctatgggatctagaaatgagacatactggcatggagagtgagaacgacaaaggaatgaagagctacaggagcatttaggccatttctatgccaagcttattctacatgcacaaaatcatacatgttaataaatataaacaaattggaggcttatttaaaccaattatgaaatctggtaatttgtgcagcagcaatagatgataaccaaaaaaaactcataataatctgaatatcttgatcatttgtatttaaagaagcagtaattatatacttgaaagtacataatatagtattgcaaaaatgactttggtatattacaaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatggtatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaaaaaaagaaaaaagaaagaaagaaaaaaggcagaagccctggattcaaatccgccacacattcagtttctttatctgtaaaatggagaccaccccccgccacgctgaacggtgattctgtgactggtaagagatgctacatttttggtgcttgttcaggtggaggaaagatgatagttaacactcaggtaataagtattttgaaggcagtataatataccttcttaaagagtatacctactcaaatgttggtaaatgttgacatgattgaatctaaatggcaaagagtattttagaaaaacattaagtccctgcagataaatgacagtgttgatttggatgcttaattacattcagacatgaactgttggatgtatctgaaatgttaaaagctttttctcaacatttccaaaagtctttccaagaaatcaatgttatgttttgttccagaagcaaatttgcatttgtgatctgtttctaaaaatggtacaagttagctctgtttagaaagtaaaaatatctgatgttagattggaagtatctcttcctggggaatccagaaagataagcatagcatattgtcttactgcaatagataagttgcttattgagaagtctggttgttattctatatggtaacaatacagttgatgtatattttatgatagatcctttatattttcctcatgactttagaagggggaagggggagaaaattatgatgaccagactagttaaagagcattgaaagtccacagtactgtagctaaagtagaagtttgggtttgttatagactttacattatatcaactaataagcagatactgtacagtattgctcaccattttatcatacttttgcatatgaactactccattgccttttatagatgttttatagctgatcttaccagttttcctggtaactttttttatttcttttttttttttttgagacggagtctcgccctaacacccaggttggagtgcagtgccgtgatctcggctcactgcaacctctgcctcccgggttcaagcaattctcctgtctcagcctcccgagtacctgggactaccggtgcctgtctccacgcccggctaattttttgtatttgtagtagagacggggtttcaccgtgttagccaggatggtctcgatctcctgacctcatgatctgcctgcctctgcctggacctcccaaagtgctgggattacaggcgtgagcccccgcgcccagccactttctttaatactataactaagaatttattaaaatgcacaaattgtctaagactgtaaagtttattggggagaggccatgactacctctgaatttagtaaatttaaaatatttctgattctcaataaagaactaatatccatataaa

SEQ ID NO: 114322 - DNA, 454 bp, Homo sapiens
  Payload ID: 2345
  Gene Symbol: CPM
  Gene Name: carboxypeptidase M
  ENST ID: ENST00000548262
  CDS Start-End: 46-454
gggtgggtagaggtgcgcgcctgggacctggtgaggctggggaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctg

SEQ ID NO: 114323 - DNA, 536 bp, Homo sapiens
  Payload ID: 2345
  Gene Symbol: CPM
  Gene Name: carboxypeptidase M
  ENST ID: ENST00000547134
  CDS Start-End: 34-228
ataacacccggccccgccgggcggccgcggaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttattacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttg

SEQ ID NO: 114324 - DNA, 1863 bp, Homo sapiens
  Payload ID: 2346
  Gene Symbol: CPN1
  Gene Name: carboxypeptidase N, polypeptide 1
  Uniprot ID: P15169
  ENST ID: ENST00000370418
  CDS Start-End: 253-1629
tgcaaaaaacctttcaaaaggctttcctggattagagaaagaaagggagtgagggaggagagatgagtggctattccagaacgacataaagaatttccagccttggacggacagctgggaacgtcttccaatttggactggtgtttacaagcgggaagctaggtggaccttggattttggcgggtgaagaggctaggttgtttaaggaggtggggcgcgtttcagtggctctctttgaaaaagcccagcaagatgtcagacctgctctcagtcttcctccacctcctccttctcttcaagttggttgccccggtgacctttcgccaccaccgctatgatgatcttgtgcggacgctgtacaaggtgcaaaacgaatgccccggcatcacgcgggtctacagcattgggcgcagcgtggaggggagacacctctacgtgctggagttcagcgaccaccctggaatccacgagcccttggaaccagaggtcaagtatgtggggaacatgcacggcaacgaagcgttgggccgcgagctgatgctgcagctgtcggagtttctgtgcgaggagttccggaacaggaaccagcgcatcgtccagctcatccaggacacgcgcattcacatcctgccatccatgaaccccgacggctacgaggtggctgctgcccagggcccaaacaagcctgggtatctagttggcaggaacaatgcaaatggagtggacctgaaccgcaacttccctgatctcaatacctatatctactataacgagaagtacggaggccccaaccaccacctgccccttccagacaactggaaaagtcaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaagctggccaaggtctactcctatgcacatggatggatgttccaaggttggaactgcggagattacttcccagatggcatcaccaatggggcttcctggtattctctcagcaagggaatgcaagactttaattatctccataccaactgctttgagatcacgctggaactgagttgcgacaagtttccccccgaagaggagttacagcgggagtggctgggtaatcgggaagccctaatccagttcctggaacaggttcaccagggcatcaagggaatggtgcttgatgagaattacaataatctcgccaatgctgtcatttctgtcagtgggattaaccatgatgtcacttcaggtgaccatggtgattacttccggctgctgcttccaggtatctacactgttagtgccacagcacctgggtatgacccagagacagtaactgtgaccgtgggtcctgcggaaccaacgttggttaacttccacctcaaaagaagcatccctcaagtaagccctgtgaggagagctcccagcagaaggcacggagtcagagccaaagtgcagccccaagccagaaagaaagaaatggagatgaggcagctgcagagaggccctgcctgaaacccacagtgccaggcaacccttcagaaaggctttgctcctgctctcagatcagatcaagcattctttctattttattatctgggacatatttaaatacaaacatattcagaacaattcagaatggtctccatctgttccaggggtaagccatctctaggtcatcatgaaaaaaattaggatctattgaaaggtgatgtggtggccgggtgtggtggctcacatctgtaatcc

SEQ ID NO: 114325 - DNA, 669 bp, Homo sapiens
  Payload ID: 2346
  Gene Symbol: CPN1
  Gene Name: carboxypeptidase N, polypeptide 1
  ENST ID: ENST00000441382
  CDS Start-End: 58-669
cgccaacctctcgcctcctcccaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaagctggccaaggtctactcctatgcacatggatggatgttccaaggttggaactgcggagattacttcccagatggcatcaccaatggggcttcctggtattctctcagcaagggaatgcaagactttaattatctccataccaactgctttgagatcacgctggaactgagttgcgacaagtttccccccgaagaggagttacagcgggagtggctgggtaatcgggaagccctaatccagttcctggaacaggttcaccagggcatcaagggaatggtgcttgatgagaattacaataatctcgccaatgctgtcatttctgtcagtgggattaaccatgatgtcacttcaggtgaccatggtgattacttccggctgctgcttccaggtatctacactgttagtgccacagcacctgggtatgacccagagacagtaactgtgaccgtgggtcctgcggaa

SEQ ID NO: 114326 - DNA, 3028 bp, Homo sapiens
  Payload ID: 2347
  Gene Symbol: CPN2
  Gene Name: carboxypeptidase N, polypeptide 2
  Uniprot ID: P22792
  ENST ID: ENST00000323830
  CDS Start-End: 91-1728
ggattgagctgaccacaggccacaccagactcctctctgctcctgaggaagacagggcagcccggcgccacccgctcggccctcacgaagatgctccctggagcctggctgctctggacctccctcctgctcctggccaggcctgcccagccctgtcccatgggttgtgactgcttcgtccaggaggtgttctgctcagatgaggagcttgccaccgtcccactggacatcccgccatatacgaaaaacatcatctttgtggagacctcgttcaccacattggaaaccagagcttttggcagtaaccccaacttgaccaaggtggtcttcctcaacactcagctctgccagtttaggccggatgccttcggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccgtgcctggttggcctgtctctgacccataaccagctggagactgtcgctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggagggcatcttcgacaccaactacaacctgttcaacctggccctgcacggtaacccctggcagtgcgactgccacctggcctacctcttcaactggctgcagcagtacaccgatcggctcctgaacatccagacctactgcgctggccctgcctacctcaaaggccaggtggtgcccgccttgaatgagaagcagctggtgtgtcccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcagcagggctccctgggactgcagtacaatgctagtcaggagtgggacctgaggtcgagctgcggttctctgcggctcaccgtgtctatcgaggctcgggcagcagggccctagtagcagcgcatacaggagctggggaagggggcctctggggcctgaccaggcgacaggtaggggcggaggggagctgagtctccgaagccttggcttttcacatgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacgatcctttatcttaacctgaacattcctttccattgatcccaggtcttcagctaagctcaaccaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaatatttta

SEQ ID NO: 114327 - DNA, 2008 bp, Homo sapiens
  Payload ID: 2347
  Gene Symbol: CPN2
  Gene Name: carboxypeptidase N, polypeptide 2
  Uniprot ID: P22792
  ENST ID: ENST00000429275
  CDS Start-End: 78-1715
gaccacaggccacaccagactcctctctgctcctgaggaagacagggcagcccggcgccacccgctcggccctcacgatgctccctggagcctggctgctctggacctccctcctgctcctggccaggcctgcccagccctgtcccatgggttgtgactgcttcgtccaggaggtgttctgctcagatgaggagcttgccaccgtcccactggacatcccgccatatacgaaaaacatcatctttgtggagacctcgttcaccacattggaaaccagagcttttggcagtaaccccaacttgaccaaggtggtcttcctcaacactcagctctgccagtttaggccggatgccttcggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccgtgcctggttggcctgtctctgacccataaccagctggagactgtcgctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggagggcatcttcgacaccaactacaacctgttcaacctggccctgcacggtaacccctggcagtgcgactgccacctggcctacctcttcaactggctgcagcagtacaccgatcggctcctgaacatccagacctactgcgctggccctgcctacctcaaaggccaggtggtgcccgccttgaatgagaagcagctggtgtgtcccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcagcagggctccctgggactgcagtacaatgctagtcaggagtgggacctgaggtcgagctgcggttctctgcggctcaccgtgtctatcgaggctcgggcagcagggccctagtagcagcgcatacaggagctggggaagggggcctctggggcctgaccaggcgacaggtaggggcggaggggagctgagtctccgaagccttggcttttcacatgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctga

SEQ ID NO: 114328 - DNA, 1209 bp, Homo sapiens
  Payload ID: 2348
  Gene Symbol: CPO
  Gene Name: carboxypeptidase O
  Uniprot ID: Q8IVL8
  ENST ID: ENST00000272852
  CDS Start-End: 47-1171
ccactgccagagaggcccagaattttctaacttactgtgtggcagaatgaagcctctgcttgaaaccctttatcttttggggatgctggttcctggagggctgggatatgatagatccttagcccaacacagacaagagattgtggacaagtcagtgagtccatggagcctggagacgtattcctataacatataccaccccatgggagagatctatgagtggatgagagagatcagtgagaagtacaaggaagtggtgacacagcatttcctaggagtgacctatgagacccaccccatgtattatctgaagatcagccaaccatctggtaatcccaagaaaatcatttggatggactgtggaattcacgccagagaatggattgctcctgctttttgccaatggttcgtcaaagaaattctacaaaaccataaagacaactcaagtatacgcaagctccttaggaacctggacttctatgtccttccagttcttaacatagatggttatatctacacttggacaactgatcgtctttggaggaaatcccgttcaccccataataatggcacatgttttgggacggatctcaatcgaaatttcaatgcatcttggtgtagtattggtgcctctagaaactgccaagatcaaacattctgtgggacagggccagtgtctgaaccagagactaaagctgttgccagcttcatagagagcaagaaggatgatattttgtgcttcctgaccatgcactcttatgggcagttaattctcacaccttacggctacaccaaaaataaatcaagtaaccacccagaaatgattcaagttggacagaaggcagcaaatgcattgaaagcaaagtatggaaccaattatagagttggatcgagtgcagatattttatatgcctcatcagggtcttcaagagattgggcccgagacattgggattcccttctcatatacgtttgagctgagggacagtggaacatatgggtttgttctgccagaagctcagatccagcccacctgtgaggagaccatggaggctgtgctgtcagtcctggatgatgtgtatgcgaaacactggcactcggacagtgctggaagggtgacatctgccactatgctgctgggcctgctggtgtcctgcatgtctcttctctaagtgcattctgcccaggcctgctcaaccccagtggcatg

SEQ ID NO: 114329 - DNA, 1947 bp, Homo sapiens
  Payload ID: 2349
  Gene Symbol: CPQ
  Gene Name: carboxypeptidase Q
  Uniprot ID: Q9Y646
  ENST ID: ENST00000220763
  CDS Start-End: 211-1629
aggtctttgccccgcctctcggccccgcggcctggccggcaagcagggctgcagtcacggggcggcgcggagggccccagcccagtcaggggtgtggccgccgccaccgtaaggctaggccgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaataccgaacgcagggggcggtggaagctgccaaggtgggggctttggcatctctcattcgatccgtggcctccttctccatctacagtcctcacacaggtattcaggaataccaggatggcgtgcccaagattccaacagcctgtattacggtggaagatgcagaaatgatgtcaagaatggcttctcatgggatcaaaattgtcattcagctaaagatgggggcaaagacctacccagatactgattccttcaacactgtagcagagatcactgggagcaaatatccagaacaggttgtactggtcagtggacatctggacagctgggatgttgggcagggtgccatggatgatggcggtggagcctttatatcatgggaagcactctcacttattaaagatcttgggctgcgtccaaagaggactctgcggctggtgctctggactgcagaagaacaaggtggagttggtgccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacagtaagaaagaaacgttttcatgcttctggccaggaatcctgggtctgcaactttggaaaactcctcttcacataacaatttcatccaattcatcttcaaagcacaactctatttcatgctttctgttattatctttcttgatactttccaaattctctgattctagaaaaaggaatcattctcccctccctcccaccacatagaatcaacatatggtagggattacagtgggggcatttctttatatcacctcttaaaaacattgtttccactttaaaagtaaacacttaataaatttttggaagatctctga

SEQ ID NO: 114330 - DNA, 466 bp, Homo sapiens
  Payload ID: 2349
  Gene Symbol: CPQ
  Gene Name: carboxypeptidase Q
  ENST ID: ENST00000522617
  CDS Start-End: 1-392
ccttccagtattatcagttacacaaggtaaatatttccaactacagtctggtgatggagtctgacgcaggaaccttcttacccactgggctgcaattcactggcagtgaaaaggccagggccatcatggaggaggttatgagcctgctgcagcccctcaatatcactcaggtcctgagccatggagaagggacagacatcaacttttggatccaagctggagtgcctggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatgctgcctaggtcctagaaacactgtcctgccagtgaggcactgttgacccatcgtgcctgggcctaactgtcatgtagaaatagtttctg

SEQ ID NO: 114331 - DNA, 660 bp, Homo sapiens
  Payload ID: 2349
  Gene Symbol: CPQ
  Gene Name: carboxypeptidase Q
  ENST ID: ENST00000517742
  CDS Start-End: 103-660
gtcgccgccgtcagagccgccctatcagagttcctaccattttgtggttccagcagcttctgttccagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcagcattgggactcctccagaaggcattacagcagaagttctggtggtgacctctttcgatgaactgcagagaagggcctcagaagcaagagggaagattgttgtttataaccaaccttacatcaactactcaaggacggtgcaatac

SEQ ID NO: 114332 - DNA, 677 bp, Homo sapiens
  Payload ID: 2349
  Gene Symbol: CPQ
  Gene Name: carboxypeptidase Q
  ENST ID: ENST00000521142
  CDS Start-End: 288-677
gcacatcaactcctgatacgcacgagctagcctgaactctgtgatgaccatcagatgcagataaactgccagacagagaagctgtcttgtagatgtgactttgctgccttcaagagcagggctttctgcacctatgctctaagcgcccttagtgttcctctcccagtggtcctggattgatttctctaatggggagcctcctctgtagggtctacaaggtgactggtggattgattgccctactccacgtaatattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagata

SEQ ID NO: 114333 - DNA, 566 bp, Homo sapiens
  Payload ID: 2349
  Gene Symbol: CPQ
  Gene Name: carboxypeptidase Q
  ENST ID: ENST00000519900
  CDS Start-End: 172-566
ctccgtcgccgccgtcagagccgccctatcaggagtttccctacacaagctctttgcctgctgccatccatgtaagacatgacttgctcctccttcctttccaccattattatgaggcctcccagccctgtgtaactattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccat

SEQ ID NO: 114334 - DNA, 553 bp, Homo sapiens
  Payload ID: 2349
  Gene Symbol: CPQ
  Gene Name: carboxypeptidase Q
  ENST ID: ENST00000519484
  CDS Start-End: 141-553
aaagctgtaaaagtctcagttaggatgtgtgttgattaaactgtggtgtggctgagcattttgcctgaaacttcatagggaataagcatctgttaatgactttcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgagcgattggcacttctggttgatactgttggacccagactgagtggctccaagaacctagaaaaagccatccaaattatgtaccaaaacctgcagcaagatgggctggagaaagttcacctggagccagtgagaataccccactgggagaggggagaagaatcagctgtgatgctggagccaagaattcataagatagccatcctgggtcttggcagcag

SEQ ID NO: 114335 - DNA, 2391 bp, Homo sapiens
  Payload ID: 2350
  Gene Symbol: CPXM1
  Gene Name: carboxypeptidase X (M14 family), member 1
  Uniprot ID: Q96SM3
  ENST ID: ENST00000380605
  CDS Start-End: 66-2270
tcggcaggaagagaccgacccgccacccgccgtagcccgcgcgcccctggcactcaatccccgccatgtgggggctcctgctcgccctggccgccttcgcgccggccgtcggcccggctctgggggcgcccaggaactcggtgctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttagctca

SEQ ID NO: 114336 - DNA, 3554 bp, Homo sapiens
  Payload ID: 2351
  Gene Symbol: CPXM2
  Gene Name: carboxypeptidase X (M14 family), member 2
  Uniprot ID: Q8N436
  ENST ID: ENST00000241305
  CDS Start-End: 156-2426
gccggtcacacgcgcagccagccggccgcctcccgcgcccaagcgcgccgctctgctgtgccctgcgcccttgccccgcgccagcttctgcgcccgcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcagaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagaccctt

SEQ ID NO: 114337 - DNA, 2512 bp, Homo sapiens
  Payload ID: 2351
  Gene Symbol: CPXM2
  Gene Name: carboxypeptidase X (M14 family), member 2
  ENST ID: ENST00000615851
  CDS Start-End: 1838-2512
gggggctttcttgggcttggctgcttggaacacctgcctccaaggaccggcctcggaggggtcgccgggaaagggagggaagaaggaagggcggggccggcccccctgcgcccgccccgcgcctctgcgcgcccctgtccgccccggcccagcccagcccagccccgcgggccggtcacacgcgcagccagccggccgcctcccgcgcccaagcgcgccgctctgctgtgccctgcgcccttgccccgcgccagcttctgcgcccgcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacaggcagagtttccctgcagaagctttctcttgcctgccgccgtgtgagatgtgcttttgctctttcttcatcttccaccatgattgtgaggcctccccagccatatggaactgtgcctcactctagtcctgaccctgttaccaccaaaatatccccactgaggaacttctag

SEQ ID NO: 114338 - DNA, 2136 bp, Homo sapiens
  Payload ID: 2352
  Gene Symbol: CPZ
  Gene Name: carboxypeptidase Z
  Uniprot ID: Q66K79
  ENST ID: ENST00000315782
  CDS Start-End: 79-2004
agcgagcgcagagccccggccccgcgcggcccgagtgccacatcactgcgctggccgtccaaggtccgccgccccaccatgccgcccccgctgccgctgctgctccttacagtcctggtcgtcgccgctgcccggccggggtgcgagtttgagcggaaccccgccgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccac

SEQ ID NO: 114339 - DNA, 2267 bp, Homo sapiens
  Payload ID: 2352
  Gene Symbol: CPZ
  Gene Name: carboxypeptidase Z
  Uniprot ID: Q66K79
  ENST ID: ENST00000360986
  CDS Start-End: 175-2133
agcggcatcctctctctagcttctggcgctgcccactgtaacccgactccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgctgccgctgctgctccttacagtcctggtcgtcgccgctgcccggccggggtgcgagtttgagcggaaccccgccggtgaatgccacaggccaccagctgcagacagcgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactt

SEQ ID NO: 114340 - DNA, 2538 bp, Homo sapiens
  Payload ID: 2352
  Gene Symbol: CPZ
  Gene Name: carboxypeptidase Z
  Uniprot ID: Q66K79
  ENST ID: ENST00000382480
  CDS Start-End: 849-2396
agcggcatcctctctctagcttctggcgctgcccactgtaacccgactccggcatttgcgtttggggcgccctccctgcgccgggggcgggagcccagcgagcgcagagccccggccccgcgcggcccgagtgccacatcactgcgctggccgtccaaggtccgccgccccaccatgccgcccccgctgccgctgctgctccttacagtcctggtcgtcgccgctgcccggccggggtgcgagtttgagcggaaccccgccggtgaatgccacaggccaccagctgcagacagcggtacagtaccgggacctccctggcttctgttctgtaggagggctgcagcccccacactgtcagagcactttaggcagctgaatccgtgatttcagaagctctgattcctgcacagtagctgttgtcctggtcctcccctgccagaccgtgggtgcccctccctgcaggccctggccctgcgtggggtcccctacgtaaatgtctgatgcgtgacggtcagggccactgcaggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactttgcactgg

SEQ ID NO: 114341 - DNA, 2464 bp, Homo sapiens
  Payload ID: 2352
  Gene Symbol: CPZ
  Gene Name: carboxypeptidase Z
  ENST ID: ENST00000515606
  CDS Start-End: 109-318
gcgccctccctgcgccgggggcgggagcccagcgagcgcagagccccggccccgcgcggcccgagtgccacatcactgcgctggccgtccaaggtccgccgccccaccatgccgcccccgctgccgctgctgctccttacagtcctggtcgtcgccgctgcccggccggggtgcgagtttgagcggaaccccgccggtgaatgccacaggccaccagctgcagacagcggtacagtaccgggacctccctggcttctgttctgtaggagggctgcagcccccacactgtcagagcactttaggcagctgaatccgtgatttcagaagctctgattcctgcacagtagctgttgtcctggtcctcccctgccagaccgtgggtgcccctccctgcaggccctggccctgcgtggggtcccctacgtaaatgtctgatgcgtgacggtcagggccactgcaggagggactgacctgccgaccctgcctccccagccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgcgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacatactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccactgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccactt

SEQ ID NO: 114342 - DNA, 2091 bp, Homo sapiens
  Payload ID: 2353
  Gene Symbol: CPVL
  Gene Name: carboxypeptidase, vitellogenic-like
  Uniprot ID: Q9H3G5
  ENST ID: ENST00000265394
  CDS Start-End: 120-1550
gtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaagtgagcttttgtttttggggggagatgtttactacaaaattaacatgagtacatgagtaagaattacattatttaacttaaaggatgaaaggtatggatgatgtgacactgagacaagatgtataaatgaaattttagggtcttgaataggaagttttaatttcttctaagagtaagtgaaaagtgcagttgtaacaaacaaagctgtaacatctttttctgccaataacagaagtttggcatgccgtgaaggtgtttggaaatattattggataagaatagctcaattatcccaaataaatggatgaagctataatagttttggggaaaagattctcaaatgtataaagtcttagaacaaaagaattctttgaaataaaaatattatatataaaagtaa

SEQ ID NO: 114343 - DNA, 1739 bp, Homo sapiens
  Payload ID: 2353
  Gene Symbol: CPVL
  Gene Name: carboxypeptidase, vitellogenic-like
  Uniprot ID: Q9H3G5
  ENST ID: ENST00000396276
  CDS Start-End: 168-1598
agcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaacaa

SEQ ID NO: 114344 - DNA, 2213 bp, Homo sapiens
  Payload ID: 2353
  Gene Symbol: CPVL
  Gene Name: carboxypeptidase, vitellogenic-like
  Uniprot ID: Q9H3G5
  ENST ID: ENST00000409850
  CDS Start-End: 648-2078
gctcctttcgcttttcgctcgctgcactccaagccccggaacacccgcgtccgcacactaagggcaccaccgctctcccacctctgcgctgtcagatgtcaggcgcggaggtgctctgggcaccgaggtgctggcgaaccaaacaagtatcaccccggacgcctgcccccattccgagagagcgggcgggatggccacaggctgcaatacagtgacacgatcacagctcactgctacagcctctacctcctgggcttaatccatcctccctcctcagcctcccaagcagctgggactacaggtgattttgatatgctgctaaggtttgataagagaaatgagattcagagaacagattatattgttgaagagcttgactggaaatgatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttg

SEQ ID NO: 114345 - DNA, 553 bp, Homo sapiens
  Payload ID: 2353
  Gene Symbol: CPVL
  Gene Name: carboxypeptidase, vitellogenic-like
  ENST ID: ENST00000447426
  CDS Start-End: 129-553
gactcactctagttgaaagccctgggggaaggaacaaactctgcagcctgactgctgtgtttaatcccagctctcctctactagctggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagc

SEQ ID NO: 114346 - DNA, 679 bp, Homo sapiens
  Payload ID: 2353
  Gene Symbol: CPVL
  Gene Name: carboxypeptidase, vitellogenic-like
  ENST ID: ENST00000432534
  CDS Start-End: 1-541
aaagtacttccagaagcagtgccatgaatgcatagaacacatcaggaagcagaactggtttgaggcctttgaagaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaa

SEQ ID NO: 114347 - DNA, 561 bp, Homo sapiens
  Payload ID: 2353
  Gene Symbol: CPVL
  Gene Name: carboxypeptidase, vitellogenic-like
  ENST ID: ENST00000455893
  CDS Start-End: 1-426
attatagggggctatgcagaattcctgtaccaaattggcttgttggatgagaagcaaaaaaagtacttccagaagcagtgccatgaatgcatagaacacatcaggaagcagaactggtttgaggcctttgaagttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttg

SEQ ID NO: 114348 - DNA, 874 bp, Homo sapiens
  Payload ID: 2353
  Gene Symbol: CPVL
  Gene Name: carboxypeptidase, vitellogenic-like
  ENST ID: ENST00000448959
  CDS Start-End: 141-874
atctaatcactccatttcatccagactgagatagatggctcacatttttgttgttattgttttctgtaatccttgggtaaattttttttcccccactaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattacta

SEQ ID NO: 114349 - DNA, 571 bp, Homo sapiens
  Payload ID: 2353
  Gene Symbol: CPVL
  Gene Name: carboxypeptidase, vitellogenic-like
  ENST ID: ENST00000455544
  CDS Start-End: 441-571
aaacaaagaaaatcaagtctgcgaggagcgagggtttgctcccctctgctccggatttgggtgtccagggtagcgggcgcggcacggcaaacaggtgattttgatatgctgctaaggtttgataagagaaatgagattcagagaacagattatattgttgaagagcttgactggaaatgatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatt

SEQ ID NO: 114350 - DNA, 528 bp, Homo sapiens
  Payload ID: 2353
  Gene Symbol: CPVL
  Gene Name: carboxypeptidase, vitellogenic-like
  ENST ID: ENST00000449801
  CDS Start-End: 372-528
gtcagatgtcaggcgcggaggtgctctgggcaccgaggtgctggcgaaccaaacaagtatcaccccggacgcctgcccccattccgagagagcgggcgggatggccacagatccaaacggaaacattggctcttcctggggttccagcctgctgtcttgacaggaactataccatcagctctcctgggtctcttacatgccaagtcatcctgcagatctgggactcactccgtaatcagcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctggga

SEQ ID NO: 114351 - DNA, 524 bp, Homo sapiens
  Payload ID: 2353
  Gene Symbol: CPVL
  Gene Name: carboxypeptidase, vitellogenic-like
  ENST ID: ENST00000437527
  CDS Start-End: 505-524
aaagaaaatcaagtctgcgaggagcgagggtttgctcccctctgctccggatttgggtgtccagggtagcgggcgcggcacggcaaacaggtcggggcgctctgcttcaccccaaccttctccgccccgccagcccccgctccagctgcgccagaaagtgcgagcctgcccgctcctttcgcttttcgctcgctgcactccaagccccggaacacccgcgtccgcacactaagggcaccaccgctctcccacctctgcgctgtcagatgtcaggcgcggaggtgctctgggcaccgaggtgctggcgaaccaaacaagtatcaccccggacgcctgcccccattccgagagagcgggcgggatggccacaggcttgattgctgtaagttgaacacgtcagtggcatgggcaccagctgcacaaccctaggagccaccaaacacagtatattctatataaatgttgctgccaggagccccagttcaaactacaataccctgagagatggttggtgccatgtggaa

SEQ ID NO: 114352 - DNA, 525 bp, Homo sapiens
  Payload ID: 2353
  Gene Symbol: CPVL
  Gene Name: carboxypeptidase, vitellogenic-like
  ENST ID: ENST00000458405
  CDS Start-End: 224-525
aaaagacttgactgcatgataagaagacaccagcatatgaggcacagcctcattcaaagaaccaaagatgatcagtactttgctcatagtggagagtggttactgaggtctggggaggttttgtaggatttagtcacagccctgtaacacagagaggatttggatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcat

SEQ ID NO: 114353 - DNA, 1094 bp, Homo sapiens
  Payload ID: 2353
  Gene Symbol: CPVL
  Gene Name: carboxypeptidase, vitellogenic-like
  ENST ID: ENST00000612187
  CDS Start-End: 396-1094
cgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccccacgtggggaatcagacttttaa

SEQ ID NO: 114354 - DNA, 1563 bp, Homo sapiens
  Payload ID: 2353
  Gene Symbol: CPVL
  Gene Name: carboxypeptidase, vitellogenic-like
  ENST ID: ENST00000614864
  CDS Start-End: 354-1046
gagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaattttgtcactcccagagggacaagccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagcgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttg

SEQ ID NO: 114355 - DNA, 3519 bp, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENST ID: ENST00000161559
  CDS Start-End: 136-1716
aaagctctgggccccagggaggaggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcga

SEQ ID NO: 114356 - DNA, 3170 bp, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENST ID: ENST00000352591
  CDS Start-End: 73-1365
cagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcgaca

SEQ ID NO: 114357 - DNA, 1484 bp, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENST ID: ENST00000358394
  CDS Start-End: 93-1478
aaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagagacagaatctcaccatgttacccaggctggactcgaactcctgggctcaagcaatcctcccatctgtttcccaaagtgctgagattacagataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaac

SEQ ID NO: 114358 - DNA, 1263 bp, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENST ID: ENST00000403461
  CDS Start-End: 7-1113
gacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctc

SEQ ID NO: 114359 - DNA, 3427 bp, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENST ID: ENST00000403444
  CDS Start-End: 105-1499
acagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatca

SEQ ID NO: 114360 - DNA, 434 bp, Homo sapiens
  Payload ID: 2354
  Gene Symbol: CEACAM1
  Gene Name: carcinoembryonic antigen-related cell adhesion molecule 1 (biliary glycoprotein)
  ENST ID: ENST00000600172
  CDS Start-End: 138-434
gaggaagacagacacccaaagagatctagaatgtgaggtcaggtgttgacaagagccctggagggaacagagcagaaaaagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccat

SEQ ID NO: 114361 - DNA, 1342 bp, Homo sapiens
  Payload ID: 2354
  Gene Symbol: CEACAM1
  Gene Name: carcinoembryonic antigen-related cell adhesion molecule 1 (biliary glycoprotein)
  Uniprot ID: P13688
  ENST ID: ENST00000599389
  CDS Start-End: 108-1307
agcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagatggcgtttcaccatgttgccaaggctggtctcaaactcctgagctcaagcaatccacccgcctccacctcccaaagtgctaagattacagataatgctctaccacaagaaaatggcctctcacctggggccattgctggcattgtgattggagtagtggccctggttgctctgatagcagtagccctggcatgttttctgcatttcgggaagaccggcagctcaggaccactccaatgacccacctaacaagatgaatgaagttacttattcta

SEQ ID NO: 114362 - DNA, 417 bp, Homo sapiens
  Payload ID: 2354
  Gene Symbol: CEACAM1
  Gene Name: carcinoembryonic antigen-related cell adhesion molecule 1 (biliary glycoprotein)
  ENST ID: ENST00000471298
  CDS Start-End: 135-417
gaagacagacaagcaaagagatctagaatgtgaggtcaggtgttgacaagagccctggagggaacagagcagaaaaagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaa

SEQ ID NO: 114363 - DNA, 1583 bp, Homo sapiens
  Payload ID: 2355
  Gene Symbol: CEACAM16
  Gene Name: carcinoembryonic antigen-related cell adhesion molecule 16
  Uniprot ID: Q2WEN9
  ENST ID: ENST00000405314
  CDS Start-End: 98-1375
ggtcctgcggcagacggagccgagccccaaccaggaagggagtccgagcactgggacttcaacgccaccatctccaagactcggtttggggtgaaagatggcgctgactgggtacagctggctgctcctcagtgccacattcctgaatgtgggggccgagatctctatcaccctggagcctgcccagccgagcgaaggggacaacgtcacgctggtcgtccatgggctttcgggggaactgctcgcctacagctggtatgcggggcccacactcagcgtgtcatacctggtggccagctacatcgtgagcacaggcgatgagactcctggcccggcccacacggggcgggaggctgtgcgccccgatggcagcctggacatccagggcatcctgccccggcactcaggcacctacatcctgcagaccttcaacaggcagttgcagaccgaggtgggctacggacacgtgcaggtccatgagatcctggcccagcccacagtcttggccaacagcacagcgctggtggaacgtcgagacaccctgcgccttatgtgcagcagccccagccccaccgccgaggtccgctggttcttcaacggtggggccctgcccgtcgctctccgcctgggcctgtcccctgacggccgggtgctggccaggcatggcatccgccgggaggaggccggcgcctatcagtgtgaggtgtggaacccggtcagtgtcagccgcagcgagcccatcaacctgaccgtgtactttggcccagagcgtgtggccatcctccaggattccaccacccgcacaggctgcaccatcaaagttgacttcaacacgtccctcaccctgtggtgcgtgtccaggtcctgcccagagcccgagtatgtgtggaccttcaacgggcaggccctaaagaacggccaagaccacctcaacatcagcagcatgacagccgcccaggaggggacgtacacatgtattgcgaagaacaccaagaccctgctatctggatctgcctcagtcgtggtcaagctctctgctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagactgtcacagtgcagggcaagactgagacactggaagtggagctgcaggtggcccccctggggtaacagcgtgaccctggagacgtccagagagaagagctcttcgcaccatcctctggtcctcgccctctgagtgggaaccactcccccacagcgaggatgccaggctgtggtcctgctgttctcctgcctccaccctagagctagagccacagggccccactccctcgctgagctgttggggagccaccgaggccataaacgtcctggttaa

SEQ ID NO: 114364 - DNA, 1701 bp, Homo sapiens
  Payload ID: 2355
  Gene Symbol: CEACAM16
  Gene Name: carcinoembryonic antigen-related cell adhesion molecule 16
  Uniprot ID: Q2WEN9
  ENST ID: ENST00000587331
  CDS Start-End: 216-1493
ctgcatcctcagcgcctagaacagcacctggcaaacaataggtgctcattcagtatttgtccaataagtgaatgagtgatttactgagcatttactctgcgccagtcgtggtaagtactgtcctgcggcagacggagccgagccccaaccaggaagggagtccgagcactgggacttcaacgccaccatctccaagactcggtttggggtgaaagatggcgctgactgggtacagctggctgctcctcagtgccacattcctgaatgtgggggccgagatctctatcaccctggagcctgcccagccgagcgaaggggacaacgtcacgctggtcgtccatgggctttcgggggaactgctcgcctacagctggtatgcggggcccacactcagcgtgtcatacctggtggccagctacatcgtgagcacaggcgatgagactcctggcccggcccacacggggcgggaggctgtgcgccccgatggcagcctggacatccagggcatcctgccccggcactcaggcacctacatcctgcagaccttcaacaggcagttgcagaccgaggtgggctacggacacgtgcaggtccatgagatcctggcccagcccacagtcttggccaacagcacagcgctggtggaacgtcgagacaccctgcgccttatgtgcagcagccccagccccaccgccgaggtccgctggttcttcaacggtggggccctgcccgtcgctctccgcctgggcctgtcccctgacggccgggtgctggccaggcatggcatccgccgggaggaggccggcgcctatcagtgtgaggtgtggaacccggtcagtgtcagccgcagcgagcccatcaacctgaccgtgtactttggcccagagcgtgtggccatcctccaggattccaccacccgcacaggctgcaccatcaaagttgacttcaacacgtccctcaccctgtggtgcgtgtccaggtcctgcccagagcccgagtatgtgtggaccttcaacgggcaggccctaaagaacggccaagaccacctcaacatcagcagcatgacagccgcccaggaggggacgtacacatgtattgcgaagaacaccaagaccctgctatctggatctgcctcagtcgtggtcaagctctctgctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagactgtcacagtgcagggcaagactgagacactggaagtggagctgcaggtggcccccctggggtaacagcgtgaccctggagacgtccagagagaagagctcttcgcaccatcctctggtcctcgccctctgagtgggaaccactcccccacagcgaggatgccaggctgtggtcctgctgttctcctgcctccaccctagagctagagccacagggccccactccctcgctgagctgttggggagccaccgaggccataaacgtcctggttaa

SEQ ID NO: 114365 - DNA, 1476 bp, Homo sapiens
  Payload ID: 2356
  Gene Symbol: CEACAM18
  Gene Name: carcinoembryonic antigen-related cell adhesion molecule 18
  Uniprot ID: A8MTB9
  ENST ID: ENST00000396477
  CDS Start-End: 22-1176
ctggaggaccccaggcagctcatggacctttccagacccagatggagcctgtggaggagggtcttcctcatggccagtctgctggcctgtgggatctgccaggcctctggccaaatcttcatcacccaaaccctggggatcaagggatatcggactgtcgtggccctggataaggtccctgaggatgttcaggaatacagctggtactggggtgcaaacgacagcgcaggaaacatgattatcagccacaaaccgcccagtgcccagcagcctgggcccatgtacactggcagggagagagtgaacagagaaggcagcctgttgatcaggccgactgcattaaatgacacgggaaactacactgttcgggtggttgcaggcaatgagacccaaagagcaaccggctggctggaggttctagagttgggaagcaatctgggcatctccgtcaatgccagctccctggtggagaacatggattctgtggctgctgactgcctcacaaatgtcaccaacatcacgtggtatgtgaatgatgtgcctacctctagtagtgaccggatgacaatttccccagacggcaagaccctcgtcatcctcagggtcagccgctatgacagaacaattcagtgcatgatagagagtttcccagagatctttcagagaagtgaacgcatctctctgactgtggcctatgggcccgactatgtgctgctgaggagcaatcctgatgatttcaacggcattgtgacagctgagatcggctcccaagtggaaatggagtgtatctgctattccttcctggatctcaagtaccactggatccacaatggctccctcctgaacttctcagatgcaaagatgaacctctcgagtcttgcctgggagcagatgggccgttaccgatgcactgtggagaaccccgtgacacagctgatcatgtacatggacgtcaggatccaggccccccatgaggatcttacctgttgtccacagagatttctccatctcaggatccatggtgatgttcctcatcatgctgacagtgctgggtggcgtttacatctgtggagtcctgatccatgctctgatcaaccactactcaatcaggacaaatcgggctccatgagtgtccaccccagacctgaggacaagaccagaagggcaagcaggtgaggagagggtgatggagaagggctgggggtccccatagggccagcgaggctgaaaagggtccagggtctctttggagggtactggcaagagagggacccagcccagtcacacggaagcctggagatggaggctccagtaggaggtctgcagaccccacccgggacctgaagatgatgtcgtgggtagcgtggccattgggcgcttcatctgccaatcagagctggtcaatgggttgcaggtcggggcgggccatgcgcaaagctgggctctaattccaagcgcctcctccctcagctccgg

SEQ ID NO: 114366 - DNA, 2249 bp, Homo sapiens
  Payload ID: 2357
  Gene Symbol: CEACAM19
  Gene Name: carcinoembryonic antigen-related cell adhesion molecule 19
  Uniprot ID: Q7Z692
  ENST ID: ENST00000358777
  CDS Start-End: 481-1380
gtgaaatcccacctctgtctattggcagacttgcctcttttcctgggcctctgtttccacatctgtgcaatgggaacagttatttatggtggctgctgaatgaggcagtgtgtgtttgaacaaacccaggggaattgttcaaacagaggctgttatgactattgctacagtgactgctgttgtagtcacgctgagtgagaaaaagaggttgaagagggtcaggggaggagtcctgggaagttccccagtcaccctgaaaaactggttcaacctctgtctgtgctcccatcccagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccgtgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgtatgccagacccagttctaggctcttgcagccctggtagaaagcaaaacaaaaactcccgctttcccagagggtcacttggcaggggaaagaatcaggaaataaaataaataatgaacatg

SEQ ID NO: 114367 - DNA, 1982 bp, Homo sapiens
  Payload ID: 2357
  Gene Symbol: CEACAM19
  Gene Name: carcinoembryonic antigen-related cell adhesion molecule 19
  Uniprot ID: Q7Z692
  ENST ID: ENST00000403660
  CDS Start-End: 211-1113
cctctgtctgtgctcccatcccagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtcccagacaccttccaggacttcaactggtacctgggggaggagacgtacggaggcacgaggctatttacctacatccctgggatacaacggcctcagagggatggcagtgccatgggacagcgagacatcgtgggcttccccaatggttccatgctgctgcgccgcgcccagcctacagacagtggcacctaccaagtagccattaccatcaactctgaatggactatgaaggccaagactgaggtccaggtagctgaaaagaataaggagctgcccagtacacacctgcccaccaacgctgggatcctggcggccaccatcattggatctcttgctgccggggcccttctcatcagctgcattgcctatctcctggtgacaaggaactggaggggccagagccacagactgcctgctccgaggggccagggatctctgtccatcttgtgctcggctgtatccccagtgccttcagtgacgcccagcacatggatggcgaccacagagaagccagaattgggccctgctcatgatgctggtgacaacaacatctatgaagtgatgccctctccagtcctcctggtgtcccccatcagtgacacaaggtccataaacccagcccggcccctgcccacacccccacacctgcaggcggagccagagaaccaccagtaccagcaggacctgctaaaccccgaccctgccccctactgccagctggtgccaacttcctgatgggtcctgggccaggccagccagggagaagacaaggccccagccctcctctgggagcctcacacctgagaccagcaggacaaggccattgggggctgtggggccgatgaggtggactcagccaaagactcagcagcacatggggcaggtgtcctggcagggggacaggagactgtaacaggcccaggtccttgtgcagcccgtgaatgcacgcccgccttcggtctgttccttcaagcaagctggcctgggccatgtgcctgtgaaaggcaggctctggcccctttccatgccaaagtcccccaagatctggatatctggggacaagatggtggcctcaggcctgcctcccaggcagttggctgggctcccaactgtctgtcctcaatgccctaccccaactccactagtgaccctcagagtcttctccccttaggacaaggcagacaccccaccatgcgggcctcaggtggcagagaggcccagcctcacaggcctgtggccccacacaccagtcccagcaaggtgaccacggctgctggaccccttccctgttcaggcaggcccagcccctctcagaacctgctgccagctgctggtcttggcccccaccctgaatcttactgagtccctctgggcagcagctcccttctccaccccaccccagcacccgtcccaaatgtggcctcagcttgtcctccccttccccaaactatgcattcattcagcaataaatgagcctttgctgtatgccagacccagttctaggctcttgcagccctggtagaaagcaaaacaaaaactcccgctttcccagagggtcacttggcaggggaaagaatcaggaaataaaataaataatgaacatg

SEQ ID NO: 114368 - DNA, 475 bp, Homo sapiens
  Payload ID: 2357
  Gene Symbol: CEACAM19
  Gene Name: carcinoembryonic antigen-related cell adhesion molecule 19
  ENST ID: ENST00000592789
  CDS Start-End: 308-475
acagggtctggctctgttggcagactagagtacagtggtgagatcacagttcattgcagccttgacttctcaacgccaagtcatcctcccacctcagcctcctgagtagctatgactacagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtc

SEQ ID NO: 114369 - DNA, 608 bp, Homo sapiens
  Payload ID: 2357
  Gene Symbol: CEACAM19
  Gene Name: carcinoembryonic antigen-related cell adhesion molecule 19
  ENST ID: ENST00000591979
  CDS Start-End: 441-608
acagggtctggctctgttggcagactagagtacagtggtgagatcacagttcattgcagccttgacttctcaacgccaagtcatcctcccacctcagcctcctgagtagctatgactacagtagagacagggtttcaccatgttggccaggctggtctcaaattcctcacctcgtgatctacccaccttggcctcccaaaatgctgggattacaggcgtgagccaccgcacccagcctgcctcagagccttcaaggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtc

SEQ ID NO: 114370 - DNA, 835 bp, Homo sapiens
  Payload ID: 2357
  Gene Symbol: CEACAM19
  Gene Name: carcinoembryonic antigen-related cell adhesion molecule 19
  ENST ID: ENST00000622237
  CDS Start-End: 672-835
acagggtctggctctgttggcagactagagtacagtggtgagatcacagttcattgcagccttgacttctcaacgccaagtcatcctcccacctcagcctcctgagtagctatgactacaggggaggaggctgaggcccagagaggtgaagtcgtgtgccacaaaataccccagccatatggtggtagaaccaagttttcagccagactcaccagctcacagcagagctgccctggactctacagccattcagtgtatagctgggccactccatcattcaaggcagttcaacgtcaagattcctgatttgcctcaacctggggcctctagaagataccatcacccccaacaagctgaagacgtgtgtccggaacactcagacacacacaaagtgctatggatacaccacaccccgacctagctgtctcttcctgatggacctcactgggtagaaatgcctggcaccgcctgcctcagatccctagggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccaggg

SEQ ID NO: 114371 - DNA, 828 bp, Homo sapiens
  Payload ID: 2357
  Gene Symbol: CEACAM19
  Gene Name: carcinoembryonic antigen-related cell adhesion molecule 19
  ENST ID: ENST00000619799
  CDS Start-End: 661-828
acagggtctggctctgttggcagactagagtacagtggtgagatcacagttcattgcagccttgacttctcaacgccaagtcatcctcccacctcagcctcctgagtagctatgactacaggggaggaggctgaggcccagagaggtgaagtcgtgtgccacaaaataccccagccatatggtggtagaaccaagttttcagccagactcaccagctcacagcagagctgccctggactctacagccattcagtgtatagctgggccactccatcattcaaggcagttcaacgtcaagattcctgatttgcctcaacctggggcctctagaagataccatcacccccaacaagctgaagacgtgtgtccggaacactcagacacacacaaagtgctatggatacaccacaccccgacctagctgtctcttcctgatggacctcactgggtagaaatgcctggcaccgcctgcctcagatccctagtagagacagggtttcaccatgttggccaggctggtctcaaattcctcacctcgtgatctacccaccttggcctcccaaaatgctgggattacaggcgtgagccaccgcacccagcctgcctcagagccttcaatgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtc

SEQ ID NO: 114372 - DNA, 972 bp, Homo sapiens
  Payload ID: 2357
  Gene Symbol: CEACAM19
  Gene Name: carcinoembryonic antigen-related cell adhesion molecule 19
  ENST ID: ENST00000618372
  CDS Start-End: 805-972
acagggtctggctctgttggcagactagagtacagtggtgagatcacagttcattgcagccttgacttctcaacgccaagtcatcctcccacctcagcctcctgagtagctatgactacaggggaggaggctgaggcccagagaggtgaagtcgtgtgccacaaaataccccagccatatggtggtagaaccaagttttcagccagactcaccagctcacagcagagctgccctggactctacagccattcagtgtatagctgggccactccatcattcaaggcagttcaacgtcaagattcctgatttgcctcaacctggggcctctagaagataccatcacccccaacaagctgaagacgtgtgtccggaacactcagacacacacaaagtgctatggatacaccacaccccgacctagctgtctcttcctgatggacctcactgggtagaaatgcctggcaccgcctgcctcagatccctagtagagacagggtttcaccatgttggccaggctggtctcaaattcctcacctcgtgatctacccaccttggcctcccaaaatgctgggattacaggcgtgagccaccgcacccagcctgcctcagagccttcaaggagtataggtggagcctccagagcccatggacagggcatgctggggctgggccagccccagcggtgtctctaaggcacccctgggatccccactgagctggcctacttcagacagccagggcccacccctctggcccccttagtgtccagctcgtggccccttggcatttccacaagacgccaagatggagattcccatggggacccagggctgcttctcaaagagcctcctgctctcagcctcaatcctggtcctctggatgctccaaggctcccaggcagctctctacatccagaagattccagagcagcctcaaaagaaccaggaccttctcctgtcagtccagggtgtc

SEQ ID NO: 114373 - DNA, 2119 bp, Homo sapiens
  Payload ID: 2358
  Gene Symbol: CEACAM20
  Gene Name: carcinoembryonic antigen-related cell adhesion molecule 20
  ENST ID: ENST00000621342
  CDS Start-End: 280-2037
cggtctccagggttcctggacttcccgctctttgtgctgggcagggaaggaaagtgagccctgggggtagagggcagaggtggggtcaaagttactttcctgccaccacccctgtctgtcctgggagctgcagttactgcagtgtgtgtgtgagtttgtagcagggtgggagaggagagaagggaggtggaggggctgcacctggagtgaggactgtatctgtgtgtgcaagccggggcgacagacggcctggcacactgaagtcaggtgccgggacccatggggcctgctgactcatggggacaccactggatgggaatcctgctttcagcctcgctttgtaccgtatggagtcctccagctgcagcccagctcaccctcaatgccaacccacttgatgccacccaaagtgaggatgttgttctgcctgtgtttgggacccccaggacaccccagattcatggcagatccagagagctggccaaaccctccattgcagtcagcccaggcactgccatagagcagaaggacatggtgaccttctactgcaccactaaggacgtcaacattaccatccactgggtttccaacaacctctccattgtgttccatgagcgcatgcagctgtccaaggatggcaagatcctcaccattctcattgtccagcgggaggactcagggacttaccaatgtgaagctcgagatgcccttctgagccagaggagcgaccccatcttcctggatgtgaagtatggtcctgatcctgttgaaatcaaattggagtctggtgttgccagtggggaggtggttgaggtgatggagggctccagcatgaccttcttagcggaaacaaagtctcacccaccctgtgcctatacttggtttctccttgactccattctgtctcacaccacgagaacattcaccatccatgctgtgtccagagaacatgagggcctgtacaggtgcttggtgtccaacagtgccacccacctgtccagcctgggtactctgaaggtccgagtacttgaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacaccgggccctatgcctgtgaggtctggaactggggcagccgggcccggagtgagccccttgagctgaccatcaactatggtcctgaccaagtgcacatcaccagggagtcggcatctgagatgatcagcaccatagaggcagagctcaactccagcctgaccctgcagtgttgggccgagtccaagccaggtgctgagtatcgctggactcttgaacactccaccggggagcacctgggtgagcagctgattatcagggctctgacctgggaacacgacgggatctacaactgcacagcctccaactctctcactggcctggcccgctccacttcagtcctggtcaaggtggtaggtccccagtcctcctccctgtcctcaggggccatcgctggtattgtcatcgggatcctggctgtcattgctgtggcctcagaactgggctattttctctgcatcagaaatgccagacggccctcaaggaaaacaacagaggaccccagtcatgagacctcacaacccatcccgaaggaggagcaccccacagagcccagttccgaaagcctgagtcctgagtatcgcaatatatcccagcttcagggacggatcagagtcgaactgatgcaaccaccagaccttccagaggagacctatgagacgaagctgccttcagcaagccgtagaggcaattctttcagcccctggaagccaccacccaaacctctgatgcccccactcagattggtctccactgtgccaaaaaacatggagtcaatctatgaggtgttggggatgcagcagtgatcaacatcgataaaatgcttttccttatggaattgacatcgtagtggtaggtcggacagtagaccaaataaataattaaaat

SEQ ID NO: 114374 - DNA, 1494 bp, Homo sapiens
  Payload ID: 2358
  Gene Symbol: CEACAM20
  Gene Name: carcinoembryonic antigen-related cell adhesion molecule 20
  ENST ID: ENST00000620096
  CDS Start-End: 17-1492
tcaggtgccgggacccatggggcctgctgactcatggggacaccactggatgggaatcctgctttcagcctcgctttgtaccgtatggagtcctccagctgcagcccagctcaccctcaatgccaacccacttgatgccacccaaagtgaggatgttgttctgcctgtgtttgggacccccaggacaccccagattcatggcagatccagagagctggccaaaccctccattgcagtcagcccaggcactgccatagagcagaaggacatggtgaccttctactgcaccactaaggacgtcaacattaccatccactgggtttccaacaacctctccattgtgttccatgagcgcatgcagctgtccaaggatggcaagatcctcaccattctcattgtccagcgggaggactcagggacttaccaatgtgaagctcgagatgcccttctgagccagaggagcgaccccatcttcctggatgtgaagtatggtcctgatcctgttgaaatcaaattggagtctggtgttgccagtggggaggtggttgaggtgatggagggctccagcatgaccttcttagcggaaacaaagtctcacccaccctgtgcctatacttggtttctccttgactccattctgtctcacaccacgagaacattcaccatccatgctgtgtccagagaacatgagggcctgtacaggtgcttggtgtccaacagtgccacccacctgtccagcctgggtactctgaaggtccgagtacttgaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacaccgggccctatgcctgtgaggtctggaactggggcagccgggcccggagtgagccccttgagctgaccatcaactgtccccagtcctcctccctgtcctcaggggccatcgctggtattgtcatcgggatcctggctgtcattgctgtggcctcagaactgggctattttctctgcatcagaaatgccagacggccctcaaggaaaacaacagaggaccccagtcatgagacctcacaacccatcccgaaggaggagcaccccacagagcccagttccgaaagcctgagtcctgagtatcgcaatatatcccagcttcagggacggatcagagtcgaactgacgaagctgccttcagcaagccgtagaggcaattctttcagcccctggaagccaccacccaaacctctgatgcccccactcagattggtctccactgtgccaaaaaacatggagtcaatctatgaggagcttgtgaatccagagcccaacacttacatccaaatcaacccctccgtctaatg

SEQ ID NO: 114375 - DNA, 1809 bp, Homo sapiens
  Payload ID: 2358
  Gene Symbol: CEACAM20
  Gene Name: carcinoembryonic antigen-related cell adhesion molecule 20
  ENST ID: ENST00000614924
  CDS Start-End: 17-1807
tcaggtgccgggacccatggggcctgctgactcatggggacaccactggatgggaatcctgctttcagcctcgctttgtaccgtatggagtcctccagctgcagcccagctcaccctcaatgccaacccacttgatgccacccaaagtgaggatgttgttctgcctgtgtttgggacccccaggacaccccagattcatggcagatccagagagctggccaaaccctccattgcagtcagcccaggcactgccatagagcagaaggacatggtgaccttctactgcaccactaaggacgtcaacattaccatccactgggtttccaacaacctctccattgtgttccatgagcgcatgcagctgtccaaggatggcaagatcctcaccattctcattgtccagcgggaggactcagggacttaccaatgtgaagctcgagatgcccttctgagccagaggagcgaccccatcttcctggatgtgaagtatggtcctgatcctgttgaaatcaaattggagtctggtgttgccagtggggaggtggttgaggtgatggagggctccagcatgaccttcttagcggaaacaaagtctcacccaccctgtgcctatacttggtttctccttgactccattctgtctcacaccacgagaacattcaccatccatgctgtgtccagagaacatgagggcctgtacaggtgcttggtgtccaacagtgccacccacctgtccagcctgggtactctgaaggtccgagtacttgaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacaccgggccctatgcctgtgaggtctggaactggggcagccgggcccggagtgagccccttgagctgaccatcaactatggtcctgaccaagtgcacatcaccagggagtcggcatctgagatgatcagcaccatagaggcagagctcaactccagcctgaccctgcagtgttgggccgagtccaagccaggtgctgagtatcgctggactcttgaacactccaccggggagcacctgggtgagcagctgattatcagggctctgacctgggaacacgacgggatctacaactgcacagcctccaactctctcactggcctggcccgctccacttcagtcctggtcaaggtggtaggtccccagtcctcctccctgtcctcaggggccatcgctggtattgtcatcgggatcctggctgtcattgctgtggcctcagaactgggctattttctctgcatcagaaatgccagacggccctcaaggaaaacaacagaggaccccagtcatgagacctcacaacccatcccgaaggaggagcaccccacagagcccagttccgaaagcctgagtcctgagtatcgcaatatatcccagcttcagggacggatcagagtcgaactgatgcaaccaccagaccttccagaggagacctatgagacgaagctgccttcagcaagccgtagaggcaattctttcagcccctggaagccaccacccaaacctctgatgcccccactcagattggtctccactgtgccaaaaaacatggagtcaatctatgaggagcttgtgaatccagagcccaacacttacatccaaatcaacccctccgtctaatg

SEQ ID NO: 114376 - DNA, 1530 bp, Homo sapiens
  Payload ID: 2358
  Gene Symbol: CEACAM20
  Gene Name: carcinoembryonic antigen-related cell adhesion molecule 20
  ENST ID: ENST00000614577
  CDS Start-End: 17-1528
tcaggtgccgggacccatggggcctgctgactcatggggacaccactggatgggaatcctgctttcagcctcgctttgtaccgtatggagtcctccagctgcagcccagctcaccctcaatgccaacccacttgatgccacccaaagtgaggatgttgttctgcctgtgtttgggacccccaggacaccccagattcatggcagatccagagagctggccaaaccctccattgcagtcagcccaggcactgccatagagcagaaggacatggtgaccttctactgcaccactaaggacgtcaacattaccatccactgggtttccaacaacctctccattgtgttccatgagcgcatgcagctgtccaaggatggcaagatcctcaccattctcattgtccagcgggaggactcagggacttaccaatgtgaagctcgagatgcccttctgagccagaggagcgaccccatcttcctggatgtgaagtatggtcctgatcctgttgaaatcaaattggagtctggtgttgccagtggggaggtggttgaggtgatggagggctccagcatgaccttcttagcggaaacaaagtctcacccaccctgtgcctatacttggtttctccttgactccattctgtctcacaccacgagaacattcaccatccatgctgtgtccagagaacatgagggcctgtacaggtgcttggtgtccaacagtgccacccacctgtccagcctgggtactctgaaggtccgagtacttgaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacaccgggccctatgcctgtgaggtctggaactggggcagccgggcccggagtgagccccttgagctgaccatcaactgtccccagtcctcctccctgtcctcaggggccatcgctggtattgtcatcgggatcctggctgtcattgctgtggcctcagaactgggctattttctctgcatcagaaatgccagacggccctcaaggaaaacaacagaggaccccagtcatgagacctcacaacccatcccgaaggaggagcaccccacagagcccagttccgaaagcctgagtcctgagtatcgcaatatatcccagcttcagggacggatcagagtcgaactgatgcaaccaccagaccttccagaggagacctatgagacgaagctgccttcagcaagccgtagaggcaattctttcagcccctggaagccaccacccaaacctctgatgcccccactcagattggtctccactgtgccaaaaaacatggagtcaatctatgaggagcttgtgaatccagagcccaacacttacatccaaatcaacccctccgtctaatg

SEQ ID NO: 114377 - DNA, 2034 bp, Homo sapiens
  Payload ID: 2358
  Gene Symbol: CEACAM20
  Gene Name: carcinoembryonic antigen-related cell adhesion molecule 20
  ENST ID: ENST00000617951
  CDS Start-End: 280-2034
cggtctccagggttcctggacttcccgctctttgtgctgggcagggaaggaaagtgagccctgggggtagagggcagaggtggggtcaaagttactttcctgccaccacccctgtctgtcctgggagctgcagttactgcagtgtgtgtgtgagtttgtagcagggtgggagaggagagaagggaggtggaggggctgcacctggagtgaggactgtatctgtgtgtgcaagccggggcgacagacggcctggcacactgaagtcaggtgccgggacccatggggcctgctgactcatggggacaccactggatgggaatcctgctttcagcctcgctttgtaccgtatggagtcctccagctgcagcccagctcaccctcaatgccaacccacttgatgccacccaaagtgaggatgttgttctgcctgtgtttgggacccccaggacaccccagattcatggcagatccagagagctggccaaaccctccattgcagtcagcccaggcactgccatagagcagaaggacatggtgaccttctactgcaccactaaggacgtcaacattaccatccactgggtttccaacaacctctccattgtgttccatgagcgcatgcagctgtccaaggatggcaagatcctcaccattctcattgtccagcgggaggactcagggacttaccaatgtgaagctcgagatgcccttctgagccagaggagcgaccccatcttcctggatgtgaagtatggtcctgatcctgttgaaatcaaattggagtctggtgttgccagtggggaggtggttgaggtgatggagggctccagcatgaccttcttagcggaaacaaagtctcacccaccctgtgcctatacttggtttctccttgactccattctgtctcacaccacgagaacattcaccatccatgctgtgtccagagaacatgagggcctgtacaggtgcttggtgtccaacagtgccacccacctgtccagcctgggtactctgaaggtccgagtacttgaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacaccgggccctatgcctgtgaggtctggaactggggcagccgggcccggagtgagccccttgagctgaccatcaactatggtcctgaccaagtgcacatcaccagggagtcggcatctgagatgatcagcaccatagaggcagagctcaactccagcctgaccctgcagtgttgggccgagtccaagccaggtgctgagtatcgctggactcttgaacactccaccggggagcacctgggtgagcagctgattatcagggctctgacctgggaacacgacgggatctacaactgcacagcctccaactctctcactggcctggcccgctccacttcagtcctggtcaaggtggtaggtccccagtcctcctccctgtcctcaggggccatcgctggtattgtcatcgggatcctggctgtcattgctgtggcctcagaactgggctattttctctgcatcagaaatgccagacggccctcaaggaaaacaacagaggaccccagtcatgagacctcacaacccatcccgaaggaggagcaccccacagagcccagttccgaaagcctgagtcctgagtatcgcaatatatcccagcttcagggacggatcagagtcgaactgatgcaaccaccagaccttccagaggagacctatgagacgaagctgccttcagcaagccgtagaggcaattctttcagcccctggaagccaccacccaaacctctgatgcccccactcagattggtctccactgtgccaaaaaacatggagtcaatctatgaggtatttatgccacactga

SEQ ID NO: 114378 - DNA, 1773 bp, Homo sapiens
  Payload ID: 2358
  Gene Symbol: CEACAM20
  Gene Name: carcinoembryonic antigen-related cell adhesion molecule 20
  ENST ID: ENST00000611497
  CDS Start-End: 17-1771
tcaggtgccgggacccatggggcctgctgactcatggggacaccactggatgggaatcctgctttcagcctcgctttgtaccgtatggagtcctccagctgcagcccagctcaccctcaatgccaacccacttgatgccacccaaagtgaggatgttgttctgcctgtgtttgggacccccaggacaccccagattcatggcagatccagagagctggccaaaccctccattgcagtcagcccaggcactgccatagagcagaaggacatggtgaccttctactgcaccactaaggacgtcaacattaccatccactgggtttccaacaacctctccattgtgttccatgagcgcatgcagctgtccaaggatggcaagatcctcaccattctcattgtccagcgggaggactcagggacttaccaatgtgaagctcgagatgcccttctgagccagaggagcgaccccatcttcctggatgtgaagtatggtcctgatcctgttgaaatcaaattggagtctggtgttgccagtggggaggtggttgaggtgatggagggctccagcatgaccttcttagcggaaacaaagtctcacccaccctgtgcctatacttggtttctccttgactccattctgtctcacaccacgagaacattcaccatccatgctgtgtccagagaacatgagggcctgtacaggtgcttggtgtccaacagtgccacccacctgtccagcctgggtactctgaaggtccgagtacttgaaacactgaccatgcctcaagtcgtgccttcaagcctgaaccttgtggagaatgctaggtctgtggacctgacctgccaaaccgtcaatcagagtgtgaatgtccagtggttcctaagtggccagcccctcctgcccagtgagcacctgcagctgtcagctgacaacaggaccctaatcatccatggcctccagcggaatgacaccgggccctatgcctgtgaggtctggaactggggcagccgggcccggagtgagccccttgagctgaccatcaactatggtcctgaccaagtgcacatcaccagggagtcggcatctgagatgatcagcaccatagaggcagagctcaactccagcctgaccctgcagtgttgggccgagtccaagccaggtgctgagtatcgctggactcttgaacactccaccggggagcacctgggtgagcagctgattatcagggctctgacctgggaacacgacgggatctacaactgcacagcctccaactctctcactggcctggcccgctccacttcagtcctggtcaaggtggtaggtccccagtcctcctccctgtcctcaggggccatcgctggtattgtcatcgggatcctggctgtcattgctgtggcctcagaactgggctattttctctgcatcagaaatgccagacggccctcaaggaaaacaacagaggaccccagtcatgagacctcacaacccatcccgaaggaggagcaccccacagagcccagttccgaaagcctgagtcctgagtatcgcaatatatcccagcttcagggacggatcagagtcgaactgacgaagctgccttcagcaagccgtagaggcaattctttcagcccctggaagccaccacccaaacctctgatgcccccactcagattggtctccactgtgccaaaaaacatggagtcaatctatgaggagcttgtgaatccagagcccaacacttacatccaaatcaacccctccgtctaatg

SEQ ID NO: 114379 - DNA, 1300 bp, Homo sapiens
  Payload ID: 2359
  Gene Symbol: CEACAM21
  Gene Name: carcinoembryonic antigen-related cell adhesion molecule 21
  Uniprot ID: Q3KPI0
  ENST ID: ENST00000187608
  CDS Start-End: 41-919
ctcctctccacagaggaggacagagcaggcagcagagaccatggggcccccctcagcttgtccccacagagaatgcatcccctggcaggggctcttgctcacagcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaacctacaagtcacatacagaaattctcagattgaacaggcatctcaccatctccgtgtatacgagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatgtgctcaccatagaccccatcaggcaggaggacgctggggagtatcagtgtgaggtctccaacccagtcagctccaacaggagcgaccccctcaagctgactgtaaaatatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctaggaattgctacactctgacacaaacatttactgctggatcgaccacaaagcagatgtggcttcttaggttcctctgggagctgctcctgtgggttgatggagcgtccctgaagcccccagccctggggatggggaaggacatggagcctgagccagagaaccagctctgagtcctgaggagacacaggcctggggacaggaagggatgggggtccctgctgaatatatagagacctcaacagactgccccgggctctgggtgggccaaggcgaaggcttcccatcaccacaggaagtgggggcttgcagggaaagtgaatgggcctatggcccacccggggtcacctggaaaggatctgaataaaggggaaacttcctctca

SEQ ID NO: 114380 - DNA, 1691 bp, Homo sapiens
  Payload ID: 2359
  Gene Symbol: CEACAM21
  Gene Name: carcinoembryonic antigen-related cell adhesion molecule 21
  ENST ID: ENST00000407170
  CDS Start-End: 814-1311
agagcagaacttggactgagtcctgcaggacacaggttccgccgagcccgtcccttggcggtggtgtcactggatgctgggaagagatggtgggaagagcctccatccattggcgcgtcactaattagacaaggaggccttgggctcccttgagagagtcacggtttctcctccgttgacccgcccttcattgaactcctttacttggatattcagagcgctggacagagatcacttggcgctaacaccctcggaggtcctcacggcgctccgtcggaatgacacagtcggattcccaagctgcgaagggtgagggagggactgcagcgcaggaactgaggaggagaggcccgcgcgcccactggagccgagcggtgaggaataaccggaccgacccccgacggtgcgtgcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaacctacaagtcacatacagaaattctcagattgaacaggcatctcaccatctccgtgtatacggagaatgttctaaatttgactctgagatctctgaggatgcagcatggccccaagacactttctgttggtcactctatccacagagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatgtgctcaccatagaccccatcaggcaggaggacgctggggagtatcagtgtgaggtctccaacccagtcagctccaacaggagcgaccccctcaagctgactgtaaaatcagatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctaggaattgctacactctgacacaaacatttactgctggatcgaccacaaagcagatgtggcttcttaggttcctctgggagctgctcctgtgggttgatggagcgtccctgaagcccccagccctggggatggggaaggacatggagcctgagccagagaaccagctctgagtcctgaggagacacaggcctggggacaggaagggatgggggtccctgctgaatatatagagacctcaacagactgccccgggctctgggtgggccaaggcgaaggcttcccatcaccacaggaagtgggggcttgcagggaaagtgaatgggcctatggcccacccggggtcacctggaaaggatctgaataaaggggaaacttcctctc

SEQ ID NO: 114381 - DNA, 1008 bp, Homo sapiens
  Payload ID: 2359
  Gene Symbol: CEACAM21
  Gene Name: carcinoembryonic antigen-related cell adhesion molecule 21
  Uniprot ID: Q3KPI0
  ENST ID: ENST00000401445
  CDS Start-End: 27-908
ggaggacagagcaggcagcagagaccatggggcccccctcagcttgtccccacagagaatgcatcccctggcaggggctcttgctcacagcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaacctacaagtcacatacagaaattctcagattgaacaggcatctcaccatctccgtgtatacgagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatgtgctcaccatagaccccatcaggcaggaggacgctggggagtatcagtgtgaggtctccaacccagtcagctccaacaggagcgaccccctcaagctgactgtaaaatcagatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctaggaattgctacactctgacacaaacatttactgctggatcgaccacaaagcagatgtggcttcttaggttcctctgggagctgctcctgtgggttgatgga

SEQ ID NO: 114382 - DNA, 1435 bp, Homo sapiens
  Payload ID: 2359
  Gene Symbol: CEACAM21
  Gene Name: carcinoembryonic antigen-related cell adhesion molecule 21
  Uniprot ID: Q3KPI0
  ENST ID: ENST00000457737
  CDS Start-End: 97-672
ggacagcagagacaacagtcacagtaaccctgtctagagcgttcctggagcccaagctcctctccacagaggaggacagagcaggcagcagagaccatggggcccccctcagcttgtccccacagagaatgcatcccctggcaggggctcttgctcacagcctcacttttaactttctggaacgcacccaccactgcctggctctttattgcatcagcgccctttgaagttgctgaaggggagaatgttcatctctctgtggtttatctgcccgagaatctttacagctatggctggtacaaagggaaaacggtggagcccaaccagctaatcgcagcatatgtaatagacactcacgttaggactccagggcctgcatacagcggtcgagagacaatatcacccagtggagatctgcatttccagaacgtcaccctagaggacacgggatactacaacctacaagtcacatacagaaattctcagattgaacaggcatctcaccatctccgtgtatacggagaatgttctaaatttgactctgagatctctgaggatgcagcatggccccaagacactttctgttggtcactctatccacagagtcagtggctcagccctccatccaagccagcagcaccacagtcacagagaagggctccgtggtcctgacctgccacacaaataacactggaacctctttccagtggattttcaacaaccagcgtctgcaggtcacgaagaggatgaagctgtcctggtttaaccatgtgctcaccatagaccccatcaggcaggaggacgctggggagtatcagtgtgaggtctccaacccagtcagctccaacaggagcgaccccctcaagctgactgtaaaatatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctaggaattgctacactctgacacaaacatttactgctggatcgaccacaaagcagatgtggcttcttaggttcctctgggagctgctcctgtgggttgatggagcgtccctgaagcccccagccctggggatggggaaggacatggagcctgagccagagaaccagctctgagtcctgaggagacacaggcctggggacaggaagggatgggggtccctgctgaatatatagagacctcaacagactgccccgggctctgggtgggccaaggcgaaggcttcccatcaccacaggaagtgggggcttgcagggaaagtgaatgggcctatggcccacccggggtcacctggaaaggatctgaataaaggggaaacttcct

SEQ ID NO: 114383 - DNA, 1691 bp, Homo sapiens; identical to SEQ ID NO: 114380
  Payload ID: 2359
  Gene Symbol: CEACAM21
  Gene Name: carcinoembryonic antigen-related cell adhesion molecule 21
  ENST ID: ENST00000614555
  CDS Start-End: 814-1311

SEQ ID NO: 114384 - DNA, 1300 bp, Homo sapiens; identical to SEQ ID NO: 114379
  Payload ID: 2359
  Gene Symbol: CEACAM21
  Gene Name: carcinoembryonic antigen-related cell adhesion molecule 21
  Uniprot ID: Q3KPI0
  ENST ID: ENST00000611554
  CDS Start-End: 41-919

SEQ ID NO: 114385 - DNA, 1435 bp, Homo sapiens; identical to SEQ ID NO: 114382
  Payload ID: 2359
  Gene Symbol: CEACAM21
  Gene Name: carcinoembryonic antigen-related cell adhesion molecule 21
  ENST ID: ENST00000627877
  CDS Start-End: 97-672

SEQ ID NO: 114386 - DNA, 1008 bp, Homo sapiens; identical to SEQ ID NO: 114381
  Payload ID: 2359
  Gene Symbol: CEACAM21
  Gene Name: carcinoembryonic antigen-related cell adhesion molecule 21
  ENST ID: ENST00000629689
  CDS Start-End: 27-908

SEQ ID NO: 114387 - DNA, 710 bp, Homo sapiens
  Payload ID: 2359
  Gene Symbol: CEACAM21
  Gene Name: carcinoembryonic antigen-related cell adhesion molecule 21
  ENST ID: ENST00000632983
  CDS Start-End: 1-287
tgctcaccatagaccccatcaggcaggaggacgctggggagtatcagtgtgaggtctccaacccagtcagctccaacaggagcgaccccctcaagctgactgtaaaatatgacaacactctaggcatcctgatcggggtcctggttgggagtcttctggtggctgcacttgtgtgtttcctgctcctccgaaaaactggcagggccagcgatcagagtgacttcagggagcagcagcccccagcctccacccccggccatggaccctctgacagctccatctcctagattcccctacccagcaccagggcagctgctctcatctatgaggaattgctacactctgacacaaacatttactgctggatcgaccacaaagcagatgtggcttcttaggttcctctgggagctgctcctgtgggttgatggagcgtccctgaagcccccagccctggggatggggaaggacatggagcctgagccagagaaccagctctgagtcctgaggagacacaggcctggggacaggaagggatgggggtccctgctgaatatatagagacctcaacagactgccccgggctctgggtgggccaaggcgaaggcttcccatcaccacaggaagtgggggcttgcagggaaagtgaatgggcctatggcccacccggggtcacctggaaaggatctgaataaaggggaaacttcctctca

SEQ ID NO: 114388 - DNA, 1022 bp, Homo sapiens
  Payload ID: 2360
  Gene Symbol: CEACAM3
  Gene Name: carcinoembryonic antigen-related cell adhesion molecule 3
  Uniprot ID: P40198
  ENST ID: ENST00000344550
  CDS Start-End: 55-693
tcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaaggccgtggtccctcccacagctctgccttctcgatgtcccctctctccactgcccaggcccccctacccaaccccaggacagcagcttccatctatgagaagtggcttcttagcttcctccaggagctgctcctgtgtgttgatggagagtccccaaggcccccagccctggggatggggaaggacatgaagcctgagccagagaaccagctataagtcctgagaagacactggtgtctgggggcagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctc

SEQ ID NO: 114389 - DNA, 1316 bp, Homo sapiens
  Payload ID: 2360
  Gene Symbol: CEACAM3
  Gene Name: carcinoembryonic antigen-related cell adhesion molecule 3
  Uniprot ID: P40198
  ENST ID: ENST00000357396
  CDS Start-End: 242-1000
aaatgtagacagaagggagaaaggaagaagagaaaatgaggcaaaactgagaggggaggggacagagaggtgacctgggcagagcttcacccatgaccctggaaagtgctcctgccctgggaggaggctcagcatggaaagaggaaggacagcagagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaagaaccagcatccagcgtgacctcaaggagcagcagccccaagcccttgcccctggccgtggtccctcccacagctctgccttctcgatgtcccctctctccactgcccaggcccccctacccaaccccaggacagcagcttccatctatgaggaattgctaaaacatgacacaaacatttactgccggatggaccacaaagcagaagtggcttcttagcttcctccaggagctgctcctgtgtgttgatggagagtccccaaggcccccagccctggggatggggaaggacatgaagcctgagccagagaaccagctataagtcctgagaagacactggtgtctgggggcagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 114390 - DNA, 1640 bp, Homo sapiens
  Payload ID: 2360
  Gene Symbol: CEACAM3
  Gene Name: carcinoembryonic antigen-related cell adhesion molecule 3
  Uniprot ID: P40198
  ENST ID: ENST00000415495
  CDS Start-End: 62-595
acagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtatacccggagctgcccaagccctccatctccagcaacaactccaaccccaaggaggacaaggatgctgtggccttcacctgtgaacctgagattcacagcacaacctgcctgtagtgggtaaatggtcagagcctcccggtcagttccaggctgcagctgtccaatgacaagaggaccctcactctactcagtgtcacaaggaatgacacaggaccctatgagtgtgaaataccgaacccagtgggtgccagctacagtgacccagtcacgctgaatgtcctctgtatcttctgttcctctgtggcccaggcttccagcccaaatccacacagccagaggccaggcctctcagtccctctcaagtccagggactcagactctcacccaggctggccatcacttcctgtcccaagcaaacctgggcagacccagccttgaccaagaataggaggggagaggctgctcctgtcctgggaggctcagggtccacagcctgtgatgggagaaacagaaaatgccccaggccttcctgtgggggccgtcgccggcatcgtgaccggggtcctggtcggagtggcgctggtggccgcgctggtgtgtttcctgctccttgccaaaactggaagaaccagcatccagcgtgacctcaaggagcagcagccccaagcccttgcccctggccgtggtccctcccacagctctgccttctcgatgtcccctctctccactgcccaggcccccctacccaaccccaggacagcagcttccatctatgaggaattgctaaaacatgacacaaacatttactgccggatggaccacaaagcagaagtggcttcttagcttcctccaggagctgctcctgtgtgttgatggagagtccccaaggcccccagccctggggatggggaaggacatgaagcctgagccagagaaccagctataagtcctgagaagacactggtgtctgggggcagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 114391 - DNA, 474 bp, Homo sapiens
  Payload ID: 2360
  Gene Symbol: CEACAM3
  Gene Name: carcinoembryonic antigen-related cell adhesion molecule 3
  ENST ID: ENST00000596544
  CDS Start-End: 178-474
agacaagtctctgtgttcaaagagcttacactcttgcagagatgaagatagacacccaaagagatctagaatgtgagttcaggtgttgacaagagccctggagggaacagagcagaaaaagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccat

SEQ ID NO: 114392 - DNA, 1110 bp, Homo sapiens
  Payload ID: 2360
  Gene Symbol: CEACAM3
  Gene Name: carcinoembryonic antigen-related cell adhesion molecule 3
  Uniprot ID: P40198
  ENST ID: ENST00000630848
  CDS Start-End: 89-727
agagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaaggccgtggtccctcccacagctctgccttctcgatgtcccctctctccactgcccaggcccccctacccaaccccaggacagcagcttccatctatgaggaattgctaaaacatgacacaaacatttactgccggatggaccacaaagcagaagtggcttcttagcttcctccaggagctgctcctgtgtgttgatggagagtccccaaggcccccagccctggggatggggaaggacatgaagcctgagccagagaaccagctataagtcctgagaagacactggtgtctgggggcagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 114393 - DNA, 1205 bp, Homo sapiens
  Payload ID: 2361
  Gene Symbol: CEACAM4
  Gene Name: carcinoembryonic antigen-related cell adhesion molecule 4
  Uniprot ID: O75871
  ENST ID: ENST00000221954
  CDS Start-End: 112-846
acagaaggaggaaggtcagcagccccgacagccgacagtcacagcagctctgacaagagcgttcctggagcccagctcctctccacagaggacaagcaggcagcagagaccatgggccccccctcagccgctccccgtggagggcacaggccctggcaggggctcctgatcacagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccaaaacaacgtcccaggccttcctgtgggggccgtcgctggcatcgtgactggggtcctggttggggtggctctggtggccgccctggtgtgttttctgcttctctccaggactggaagggccagcatccagcgtgacctcagggagcagccgcccccagcctccacccctggccatggtccctctcacagatccaccttctcggcccctctacccagccccagaacagccactcccatctatgaggaattgctatactctgatgcaaacatttactgccagatcgaccacaaagcagatgtggtctcttaggttcctctgggagctgctcttgtgggttgatggagcgtccccgaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctg

SEQ ID NO: 114394 - DNA, 899 bp, Homo sapiens
  Payload ID: 2361
  Gene Symbol: CEACAM4
  Gene Name: carcinoembryonic antigen-related cell adhesion molecule 4
  ENST ID: ENST00000600925
  CDS Start-End: 112-876
acagaaggaggaaggtcagcagccccgacagccgacagtcacagcagctctgacaagagcgttcctggagcccagctcctctccacagaggacaagcaggcagcagagaccatgggccccccctcagccgctccccgtggagggcacaggccctggcaggggctcctgatcacagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccaaaacaacgtcccaggccttcctgtgggggccgtcgctggcatcgtgactggggtcctggttggggtggctctggtggccgccctggtgtgttttctgcttctctccaggactggaagcatccagcgtgacctcagggagcagccgcccccagcctccacccctggccatggtccctctcacagatccaccttctcggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgag

SEQ ID NO: 114395 - DNA, 1205 bp, Homo sapiens; identical to SEQ ID NO: 114393
  Payload ID: 2361
  Gene Symbol: CEACAM4
  Gene Name: carcinoembryonic antigen-related cell adhesion molecule 4
  Uniprot ID: O75871
  ENST ID: ENST00000616476
  CDS Start-End: 112-846

SEQ ID NO: 114396 - DNA, 899 bp, Homo sapiens; identical to SEQ ID NO: 114394
  Payload ID: 2361
  Gene Symbol: CEACAM4
  Gene Name: carcinoembryonic antigen-related cell adhesion molecule 4
  ENST ID: ENST00000626555
  CDS Start-End: 112-876

SEQ ID NO: 114397 - DNA, 2874 bp, Homo sapiens
  Payload ID: 2362
  Gene Symbol: CEACAM5
  Gene Name: carcinoembryonic antigen-related cell adhesion molecule 5
  Uniprot ID: P06731
  ENST ID: ENST00000221992
  CDS Start-End: 115-2223
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcacacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaa

SEQ ID NO: 114398 - DNA, 2451 bp, Homo sapiens
  Payload ID: 2362
  Gene Symbol: CEACAM5
  Gene Name: carcinoembryonic antigen-related cell adhesion molecule 5
  Uniprot ID: P06731
  ENST ID: ENST00000398599
  CDS Start-End: 148-2253
gatgctgagaagtactcctgccctaggaagagactcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggc

SEQ ID NO: 114399 - DNA, 2354 bp, Homo sapiens
  Payload ID: 2362
  Gene Symbol: CEACAM5
  Gene Name: carcinoembryonic antigen-related cell adhesion molecule 5
  Uniprot ID: P06731
  ENST ID: ENST00000405816
  CDS Start-End: 84-2192
agacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgcatttgcaacagctacagtctaaaattgcttctttaccaaggatatttacagaaaagactctgaccagagatcgagaccatcctagccaacatcgtgaaaccccatctctactaaaaatacaaaaa

SEQ ID NO: 114400 - DNA, 423 bp, Homo sapiens
  Payload ID: 2362
  Gene Symbol: CEACAM5
  Gene Name: carcinoembryonic antigen-related cell adhesion molecule 5
  ENST ID: ENST00000595403
  CDS Start-End: 1-423
ccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgaggctcagaacacaa

SEQ ID NO: 114401 - DNA, 581 bp, Homo sapiens
  Payload ID: 2362
  Gene Symbol: CEACAM5
  Gene Name: carcinoembryonic antigen-related cell adhesion molecule 5
  ENST ID: ENST00000595113
  CDS Start-End: 1-581
taatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctc

SEQ ID NO: 114402 - DNA, 1160 bp, Homo sapiens
  Payload ID: 2362
  Gene Symbol: CEACAM5
  Gene Name: carcinoembryonic antigen-related cell adhesion molecule 5
  ENST ID: ENST00000616453
  CDS Start-End: 84-1124
agacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactg

SEQ ID NO: 114403 - DNA, 1694 bp, Homo sapiens
  Payload ID: 2362
  Gene Symbol: CEACAM5
  Gene Name: carcinoembryonic antigen-related cell adhesion molecule 5
  ENST ID: ENST00000615021
  CDS Start-End: 84-1658
agacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactg

SEQ ID NO: 114404 - DNA, 2228 bp, Homo sapiens
  Payload ID: 2362
  Gene Symbol: CEACAM5
  Gene Name: carcinoembryonic antigen-related cell adhesion molecule 5
  ENST ID: ENST00000617332
  CDS Start-End: 84-2192
agacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactg

SEQ ID NO: 114405 - DNA, 2700 bp, Homo sapiens
  Payload ID: 2363
  Gene Symbol: CEACAM6
  Gene Name: carcinoembryonic antigen-related cell adhesion molecule 6 (non-specific cross reacting antigen)
  Uniprot ID: P40199
  ENST ID: ENST00000199764
  CDS Start-End: 219-1253
aaaagagacagaaatgagaggggaggggatagaggattcctgaacagagaccgcacccatgacccacgtgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 114406 - DNA, 571 bp, Homo sapiens
  Payload ID: 2363
  Gene Symbol: CEACAM6
  Gene Name: carcinoembryonic antigen-related cell adhesion molecule 6 (non-specific cross reacting antigen)
  ENST ID: ENST00000595740
  CDS Start-End: 472-571
taatctgttacctaacagcaggaaagcatgatctcacctgttcttgccctcaagtaggaacactgccctgggactatactgcagaccaccaggctgagccatccccagaggtcaggagcttccaaccgggaacctttcatacactcttcaagcaacgtacagctccaccgacagtcacaataaaaattctaatatcttccctcctcctgttgctgatgtccatggtctctagcagcctgaatccagacaggatcttacgctgtcgcccaagcttggagtacaatggtgcaatcatagctcattacagctcaaactcctgggctcaagcagtcttcctgcctcagtcttccaagaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactg

SEQ ID NO: 114407 - DNA, 2489 bp, Homo sapiens
  Payload ID: 2364
  Gene Symbol: CEACAM7
  Gene Name: carcinoembryonic antigen-related cell adhesion molecule 7
  Uniprot ID: Q14002
  ENST ID: ENST00000006724
  CDS Start-End: 203-1000
gaatgagaggggaggggacagaggactcctgagcagagaccccacccctggaccatgtgatcttggaaagtgctcctgccctgggaggaggctcagcacagaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggaatctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgtttttattatccacctgcagactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatct

SEQ ID NO: 114408 - DNA, 1236 bp, Homo sapiens
  Payload ID: 2364
  Gene Symbol: CEACAM7
  Gene Name: carcinoembryonic antigen-related cell adhesion molecule 7
  Uniprot ID: Q14002
  ENST ID: ENST00000401731
  CDS Start-End: 106-903
acagaggtaggaaggacagcagagctgacagtcacagcagccctgacaagagagttcctggagcccaagctcttctccacagaggacaagcaggcagcagagaccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggaatctataccctacacgttataaaagaaaatcttgtgaatgaagaagtaaccagacaattctacgtattctcggagccacccaagccctccatcaccagcaacaacttcaatccggtggagaacaaagatattgtggttttaacctgtcaacctgagactcagaacacaacctacctgtggtgggtaaacaatcagagcctcctggtcagtcccaggctgctgctctccactgacaacaggaccctcgttctactcagcgccacaaagaatgacataggaccctatgaatgtgaaatacagaacccagtgggtgccagccgcagtgacccagtcaccctgaatgtccgctatgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactcca

SEQ ID NO: 114409 - DNA, 524 bp, Homo sapiens
  Payload ID: 2364
  Gene Symbol: CEACAM7
  Gene Name: carcinoembryonic antigen-related cell adhesion molecule 7
  ENST ID: ENST00000602225
  CDS Start-End: 3-521
ccatggggtccccttcagcctgtccatacagagtgtgcattccctggcaggggctcctgctcacagcctcgcttttaaccttctggaacctgccaaacagtgcccagaccaatattgatgtcgtgccgttcaatgtcgcagaagggaaggaggtccttctagtagtccataatgagtcccagaatctttatggctacaactggtacaaaggggaaagggtgcatgccaactatcgaattataggatatgtaaaaaatataagtcaagaaaatgccccagggcccgcacacaacggtcgagagacaatataccccaatggaaccctgctgatccagaacgtcacccacaatgacgcaggaatctataccctacacgttataaaagaaaatcttgtgaatgaagaagtaaccagacaattctacgtattctatgagtcagtacaagcaagttcacctgacctctcagctgggaccgctgtcagcatcatgattggagtactggctgggatggctctgatatagcag

SEQ ID NO: 114410 - DNA, 1581 bp, Homo sapiens
  Payload ID: 2364
  Gene Symbol: CEACAM7
  Gene Name: carcinoembryonic antigen-related cell adhesion molecule 7
  ENST ID: ENST00000625696
  CDS Start-End: 1-92
atgagtcagtacaagcaagttcacctgacctctcagctgggaccgctgtcagcatcatgattggagtactggctgggatggctctgatatagcagccttggtgtagtttctgcatttcgggaagagtgtttttattatccacctgcagactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactccatttttccctgctcatgcctgcctctttaatttggtaagataatgctgtaactagaatttcacaatcagcgccttgtgcaggtaatttgacagagtgttggatgtgtcatgtcatcatgtcaaacccaaatatttgacctaagggatcctttattctgcccagtggctaactttaacaacatccctaatacaactgtttattcaaatgcacggtggtccctgttagagttagacctctagactcacctgttctcacgccctgttttaatttaacccagctatgggatgccagataacagaattgctgcctactagctgaacagggaggagtttgtgcagttgctgacacttcttgttgcacataaataaatacagtgggtactatagagactcagttgcaaaaattaacaaatatgctgcttgattaaaatgggtaggcttctcatgtggctcattctttaatctattctcttttatttggtttggttcatggggtctctgcctatggatcatacttcaaactcttggtgtgatcctcctgattgtcacaatattagttaccctggtgtgctgtattctctaaaacctttaaatgtttgcatgcagccattcgtcaaatgtcaaatattctctctttggctggaatgacaaaaactcaaataaatgtatgattaggaggacatcataacctatgaatgatggaagtccaaaatgatggtaactgacagtagtgttaatgccttatgtttagtcaaactctcatttaggtgacagcctggtgactccagaatggagccagtcatgctaaatgccatatactcacactgaaacatgaggaagcaggtagatcccagaacagacaaaattttcctaaaaacatgagagtccaggctgtctgagtcagcacagtaagaaagtcctttctgctttaactcttagaaaaaagtaatatgaagtattctgaaattaaccaatcagtttatttaaatcaatttatttatattcttctgttcctggattcccattttacaaaacccactgttctactgttgtattgcccagtaggagctatcactatattttgcagaatggaaactgccctgactcatgaatcacaaataaaagccaattgtatct

SEQ ID NO: 114411 - DNA, 425 bp, Homo sapiens
  Payload ID: 2364
  Gene Symbol: CEACAM7
  Gene Name: carcinoembryonic antigen-related cell adhesion molecule 7
  ENST ID: ENST00000628153
  CDS Start-End: 1-92
atgagtcagtacaagcaagttcacctgacctctcagctgggaccgctgtcagcatcatgattggagtactggctgggatggctctgatatagcagccttggtgtagtttctgcatttcgggaagagtgactggactggattcttctagctccttcaatcccattttctcctgtggcatcactaagtataagacctgctctcttcctgaagacctataagctggaggtggacaactcaatgtaaatttcaaggaaaaaccctcatgcctgagatgtgggccactcagagctaaccaaaatgttcaacaccataactagagacactcaaattgccaaccaggacaagaagttgatgacttcatgctgtggacagtttttcccaagatgtcccaagcctcatcgtgacgaggctcttatcccactcca

SEQ ID NO: 114412 - DNA, 95 bp, Homo sapiens
  Payload ID: 2364
  Gene Symbol: CEACAM7
  Gene Name: carcinoembryonic antigen-related cell adhesion molecule 7
  ENST ID: ENST00000626565
  CDS Start-End: 1-92
atgagtcagtacaagcaagttcacctgacctctcagctgggaccgctgtcagcatcatgattggagtactggctgggatggctctgatatagcag

SEQ ID NO: 114413 - DNA, 2305 bp, Homo sapiens
  Payload ID: 2365
  Gene Symbol: CEACAM8
  Gene Name: carcinoembryonic antigen-related cell adhesion molecule 8
  Uniprot ID: P31997
  ENST ID: ENST00000244336
  CDS Start-End: 103-1152
agcacaaaaggaggaaggacagcacagctgacagccgtgctcagaaagtttctggatcccaggctcatctccacagaggagaacacgcaggcagcagagaccatggggcccatctcagccccttcctgcagatggcgcatcccctggcaggggctcctgctcacagcctcacttttcaccttctggaacccgcccaccactgctcagctcactattgaagctgtgccatccaatgctgcagaggggaaggaggttcttctacttgtccacaatctgccccaggaccctcgtggctacaactggtacaaaggggaaacagtggatgccaaccgtcgaattataggatatgtaatatcaaatcaacagattaccccagggcctgcatacagcaatcgagagacaatataccccaatgcatccctgctgatgcggaacgtcaccagaaatgacacaggatcctacaccctacaagtcataaagctaaatcttatgagtgaagaagtaactggccagttcagcgtacatccggagactcccaagccctccatctccagcaacaactccaaccccgtggaggacaaggatgctgtggccttcacctgtgaacctgagactcagaacacaacctacctgtggtgggtaaatggtcagagtctcccggtcagtcccaggctgcagctgtccaatggcaacaggaccctcactctactcagtgtcacaaggaatgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctgatgctttagtacaaggaagttctcctggcctctcagctagagccactgtcagcatcatgattggagtactggccagggtggctctgatatagtagctctggtgtagtttctgcatttcaagaagactggcagacagttgtttttattcttcctcaaagcatttgcaatcagctaccattcaaaattgcttcttcttcaagatttatggaaaatactctgacgagtactcttgaacacaagttcctgataactttaagatcacgccactggactgtctatgaacttgcaaacaggctgatacctttgtgaagttgcccaccaaaacacagaaggaaaaaaacatgaatttcattgaactaaataataatgaggataatgtttttaagatttttttttttttttttttgagatggaatctcgctctgtcgcccaggctggagtgcagtggcacgatctcaactcactgcaagctccgcctcctgggttcacaccattctcctgcctcagcctcctgagtagctgggactacaggcgcctgccacaacgcccggctaattttttgtatttttagtagagacggggtttcactgtggtctcaatctcctgacttcatggtccgcctgcctcagcctcccaaagttctgggattacaggtgtgagccaccgcgcccagcccgtttttaagattttttatttgaaaaattgccaattctttaagtgttttctttttcagatttatgaatttctttatcttttaagctatctataccttactgcaatttggtaaagcagacttttgtgaacaaaaattataacatttacttttgctccctacctgactgccacagaactgggcaactattcatgagtattcatatgtttatggtaattcagttatttgcacaagttcagtgagaatctgctgtctttataatgggatatagtttaaaacattggttatattaccaaggctttgattgggatgttatatttgagaaaatacagagaatgatagattaacggagtgtctaatctatcgtgtcaaccccaaatttttacgtatgagatcctttagtccacccaatggctgacagtaacagcatctttaacacaactctttgttcaaatgtactatggtctcttttagagtcagactcctagactcacttgttctcactgtctgttttaatttaacccaggcatgcaatgctagataataaaattgctccctattggctgatcaga

SEQ ID NO: 114414 - DNA, 544 bp, Homo sapiens
  Payload ID: 2365
  Gene Symbol: CEACAM8
  Gene Name: carcinoembryonic antigen-related cell adhesion molecule 8
  ENST ID: ENST00000599005
  CDS Start-End: 228-383
agacagaaaataaagggaaaggagggacagggaggcaggactgagaggggaggggacagagaggtgtcctgggcacagaccccgcccatgagcctgagaagtgctcctgccccgggaagaggctcagcacaaaaggaggaaggacagcacagctgacagccgtgctcagaaagtttctggatcccaggctcatctccacagaggagaacacgcaggcagcagagaccatggggcccatctcagccccttcctgcagatggcgcatcccctggcaggggctcctgctcacagatgctttagtacaaggaagttctcctggcctctcagctagagccactgtcagcatcatgattggagtactggccagggtggctctgatatagtagctctggtgtagtttctgcatttcaagaagactggcaggtatgatggcctttcctcttgtcctgtttcctgcagggctgaccgccatgcttgggagagagacctgtatcccgggaatggatctcctcctcctcccaataaactcctgcttctcagcact

SEQ ID NO: 114415 - DNA, 1035 bp, Homo sapiens
  Payload ID: 2365
  Gene Symbol: CEACAM8
  Gene Name: carcinoembryonic antigen-related cell adhesion molecule 8
  ENST ID: ENST00000614151
  CDS Start-End: 1-1035
atggggcccctctcagcccctccctgcacacagcgcatcacctggaaggggctcctgctcacagcctcacttttcaccttctggaacccgcccaccactgctcagctcactattgaagctgtgccatccaatgctgcagaggggaaggaggttcttctacttgtccacaatctgccccaggaccctcgtggctacaactggtacaaaggggaaacagtggatgccaaccgtcgaattataggatatgtaatatcaaatcaacagattaccccagggcctgcatacagcaatcgagagacaatataccccaatgcatccctgctgatgcggaacgtcaccagaaatgacacaggatcctacaccctacaagtcataaagctaaatcttatgagtgaagaagtaactggccagttcagcgtacatccggagactcccaagccctccatctccagcaacaactccaaccccgtggaggacaaggatgctgtggccttcacctgtgaacctgagactcagaacacaacctacctgtggtgggtaaatggtcagagtctcccggtcagtcccaggctgcagctgtccaatggcaacaggaccctcactctactcagtgtcacaaggaatgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgtcaatggcacattccagcaatacacacaaaagctctttatccccaacatcactacaaagaacagcggatcctatgcctgccacaccactaactcagccactggccgcaacaggaccacagtcaggatgatcacagtctctggaagttctcctggcctctcagctagagccactgtcagcatcatgattggagtactggccagggtggctctgatatag

SEQ ID NO: 114416 - DNA, 3958 bp, Homo sapiens
  Payload ID: 2366
  Gene Symbol: CRLS1
  Gene Name: cardiolipin synthase 1
  Uniprot ID: Q9UJA2
  ENST ID: ENST00000378863
  CDS Start-End: 158-1063
tgtataagtggagtgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttgttccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattcatttcattgtcttcactgaatagacttaaccttgacagtaagcttaaagcattagtgtcatttaattacatgtctgaggaatttatgctaactagattttgggcttttgcagcgaattttagtcggggcctcattcctgagcccaagtgaccctttcacctcagcttcccaagtagctgggattacaggtgcacaccaactgtgctttgcagttttgtttgtgtgtgtgtgtgtgtgtgtgtgtgtgtgtgtgtgtgtgtgtattttgttttttttacaagcccacaacatcatagctttgcagtttttaaccaggagctggtggagatctttgaaatcatttaggccaattcttttagttacatttatgatgaaactagggatctaccttaaagttttgggaagctctttcaaaacttcagacacctagaaatatatatagtgcagttcagttttagtttctgcagcatggtttggaaacaaaagatacataggatttaaactcgatttgttttcttcttacagtagaagtaaatgctcttgtggcttgaatcgcatctcccaagaaagatacgttcacgttcaaacccccagtactgtacatgtgaccttatttggaaatagggtctttttagatgcagtcaagatagaattagatcatactggattacagtgggccccaataactaggtttttttgttaaaaaaaaaaaaaaaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaataaatgccaatgttgaaaattaaaa

SEQ ID NO: 114417 - DNA, 994 bp, Homo sapiens
  Payload ID: 2366
  Gene Symbol: CRLS1
  Gene Name: cardiolipin synthase 1
  Uniprot ID: Q9UJA2
  ENST ID: ENST00000378868
  CDS Start-End: 151-759
agttgtacagcatgggttgaggtggccagatcctggcaggggtctcaactccactgatagctaaagcatgttggggtttgaatgctggatactttgaagttgccatatcctgactgaagtccttcccagaacggcagtagttggtcgagtatgccacagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaa

SEQ ID NO: 114418 - DNA, 3859 bp, Homo sapiens
  Payload ID: 2366
  Gene Symbol: CRLS1
  Gene Name: cardiolipin synthase 1
  ENST ID: ENST00000452938
  CDS Start-End: 155-772
ataagtggagtgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagcgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggtgttttacagctttcaccacagctgcatcagcttatagttactatcattatggccggaagactgttcaggtgataaaagactgatgaaagtcatccctcactgttagtaaggaagcagtatacatcaatgggaacagggcccatggaaatgtacaggagtttccctattttggtgttcagcttgaaaaaggacttgtcagaatcaactgtgtcatcaaaatttaagtaatgtgcattgaaaataaggttgatcatgggaatatgcagaatttccaatgtatttttaaatacaaataaaattgtaatttagaatttttaatcttaggtttcttgattaatttataagagatcaattattgtcagtcttttttgtatgttttttaaaaacatagtccagagcatgggcagaattgacacctctcttttaagtgaaatttggattgctcacaaagcactaggaaatgtcatggggttcaaatatatatcctacacaactgggcaatacatttttgtttgatttttaggtctgtgtatacattaacagttcatgtaattaatacctgatcatttgggataatgaaagtgaagttagttgtagatgaagtaaagttataaaagagattaaaaatgcggtaactttttaagataataatcatacagaaggtatgaagttcattttcggtagtcttccaacctctcaggtgcctaataatttatgtttgaggataacaggtaacaaagatagtcgagataggagaacgtgtctattagtctttgcatctaaaaggcagtgagttacgttcctgccttccactgtgtttctgacatagcaatgtttgtttgatattggaacctggattcatattttatgtaaataatatcaagctgtatatttttcaaaggttttttaaactttggagactctttcttttgttaagcagttaaaggaataaaagagctggaaaaaaaattgtaccttcaactcaggttgttccatataacatacgtattctctgctgttacgtaagttttccgattcacagagtccattcatgtacatcacttacacttaaattgtaaaaataattagtctgaccatctgactttaaaagactgttgctacacgtacatcatgtttaggagaatgtgggatatggggaaggggagaagaagacagtccagtggtgactagttgctgctgcttaacctatggcctattgctgcccattgtccctggttttaatccaagcctattatggaatactgcagtgagattatccattctcagcctgttgagctgcattaaattagaatgggaggctgtaagtaaaactcatgcctcttggccaggcattctgcaccagcgtgtccctctgtggcttgctggtcctggttgttctcagactggcagctgagctgcgcttggcttgaagcatactgaagcctgcagccagggacaccgccattgaatcagatggagggggatgaaaaagcagagaagggggcatgtggctggctattcttgctctctggagaacagcttcattgttaggagtagttaggctgaaagtggacttcccactgctgagccacccaagaggcacactgagcattagtgacgggtgagccacataagaataatgtttaaaaaagagaggacttgaagtagctatgcgaaaatttagaactttgcactttgttaacgcttatttatggtttagtgttgatgccatttggagtgacctatgggttggacccatatctttttattattaaggtctcaatctggctctggttaataaacgtttcccgcttcatcccttaggaaaatggtccaagtctcctcaggcttttggatactgaattgttataaaacacatcaattctgccagtttataaaacactggaattgtattagacatgtctgagtatgtacttgtttatagactcaaaacatgatgaaaattcatttcattgtcttcactgaatagacttaaccttgacagtaagcttaaagcattagtgtcatttaattacatgtctgaggaatttatgctaactagattttgggcttttgcagcgaattttagtcggggcctcattcctgagcccaagtgaccctttcacctcagcttcccaagtagctgggattacaggtgcacaccaactgtgctttgcagttttgtttgtgtgtgtgtgtgtgtgtgtgtgtgtgtgtgtgtgtgtgtgtattttgttttttttacaagcccacaacatcatagctttgcagtttttaaccaggagctggtggagatctttgaaatcatttaggccaattcttttagttacatttatgatgaaactagggatctaccttaaagttttgggaagctctttcaaaacttcagacacctagaaatatatatagtgcagttcagttttagtttctgcagcatggtttggaaacaaaagatacataggatttaaactcgatttgttttcttcttacagtagaagtaaatgctcttgtggcttgaatcgcatctcccaagaaagatacgttcacgttcaaacccccagtactgtacatgtgaccttatttggaaatagggtctttttagatgcagtcaagatagaattagatcatactggattacagtgggccccaataactaggtttttttgttaaaaaaaaaaaaaaaggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaataaatgccaatgttg

SEQ ID NO: 114419 - DNA, 12847 bp, Homo sapiens
  Payload ID: 2367
  Gene Symbol: CMYA5
  Gene Name: cardiomyopathy associated 5
  Uniprot ID: Q8N3K9
  ENST ID: ENST00000446378
  CDS Start-End: 32-12241
ctccggccccggcccaggcccgggagaggcgatggcgagccgcgatagcaaccacgctggcgagagctttctcggctccgacggggacgaggaggcgacccgggagctggagaccgaggaggagtcggagggcgaggaggacgagacggcggcggagtcggaggaggagccggactccaggttatcagaccaggatgaagagggaaagatcaagcaggagtatatcatatctgacccctccttttccatggtgacagtccaaagggaagatagtgggataacctgggaaaccaattcaagtagatcttctactccttgggcttcagaagaaagtcagacttctggtgtgtgtagtcgggaagggtcaactgtgaattctcctcctggaaatgtttcctttattgtggatgaagtgaaaaaggttcggaaaaggactcataagtcaaagcatggttcaccatcattacgccggaaaggcaacagaaaaagaaattcttttgaatcccaagatgttccaacaaacaaaaaaggcagtcctttaacttcagcaagccaggtactaaccacggagaaagagaagtcatatactggcatttatgataaagcaagaaaaaagaagaccacttcaaatacacctccgattactggggcaatatacaaagaacacaagccattagtgttaagaccagtctacataggaacagtacaatataaaattaagatgtttaattcggttaaagaagaattaattcctctacaattttatggaacattgccaaagggttatgtaattaaagaaatacattataggaaagggaaagatgcatccattagtctagagccagatttggacaatagtggttctaatacagtgtccaaaacacgcaaattagtagcccaaagcatagaggataaagtaaaagaggtttttccaccctggagaggcgcactctccaaaggatcagagtccctaaccttaatgttcagtcatgaagatcaaaagaaaatttatgctgattctcccctaaatgccacatctgcattggagcacacagttccctcttattcaagtagtggcagagcagaacaaggaatacagctcaggcattcacagtcagtgccacaacagccagaagatgaagcaaaaccacatgaagtggaacctccatctgtgacacccgacacacctgcaactatgttcctgagaacaacaaaggaagaatgtgagcttgcttcaccaggaactgcagcttcagagaatgactcttcagtctcaccatcatttgctaatgaggtaaagaaggaagatgtgtattctgctcaccattccatttctctggaggcagcgtcaccaggtctggcagcatctacccaggatggtttggacccagaccaagaacagccggacctgacttcaatagaaagggcagaaccagtctccgcaaaactgacccctacccatcccagtgtcaaaggagagaaggaggaaaacatgcttgagccatccatttctctttctgaacctctaatgttagaagaaccagagaaagaagaaatagaaacttccctacccatagctattacccctgaacctgaagattctaatttagtagaagaagagatcgtagaacttgattacccagaaagcccattggtttccgagaagcccttcccaccacatatgtcccctgaagtggagcacaaagaagaagagcttattctaccattattggcagcatcatctcctgaacatgttgctttgtctgaggaagaaagagaggaaattgcatctgtttctactggttctgcttttgtatcagagtattcagtaccacaggatttgaaccatgaattacaggagcaagaaggtgagccagttcccccatccaatgtagaagctatagctgaacatgcagttttgtcagaagaagagaatgaggaatttgaggcttattccccagctgcagcccctacatctgagagctctctctcaccatccacaactgagaagacttcagagaaccagtctccactgttttcaacagttacaccagaatacatggtcctatcaggagacgaggcctcagaaagtgggtgttacacaccagactccacatctgcttctgaatattcagttccatcactggcaacaaaagagtcactgaagaaaacaattgaccgtaagtccccgttaatattgaaaggtgtttctgagtacatgattccatcagaagagaaggaagacactggatcgtttactccagctgtggcccctgcttctgagccctctctctcaccatccacaaccgaaaagacttctgaatgccagtcaccactgccttctactgccacatcagaacacgtggtcccatcagaaggagaggacctaggaagtgaacgtttcacaccggattcaaagttgatctccaaatatgcagccccactcaatgcaacacaggaatctcaaaagaaaataatcaatgaggcatcccaattcaaaccaaaaggtatttctgagcacacagttctgtcagtagacggcaaggaggtcattggaccatcttccccagatttggttgttgcatctgaacactctttcccaccacacacaaccgagatgacttctgaatgccaggccccaccactttcagccaccccatctgaatatgttgttctatcagacgaagaggcagtcgagttggaacgatacacaccctcttctacatctgcttctgaattttcagtaccaccatatgcaacaccggaggcacaggaggaagaaattgtccatagatctctaaatctaaaaggtgcatcctcacccatgaatttatcagaagaagatcaagaagacattggacctttttctccagattctgcatttgtgtcagaattctcatttccaccgtatgcaacccaggaagcagagaaaagagaatttgagtgcgattctccaatatgtttaacatcaccatctgagcacactattttgtcagatgaagacactgaagaagcggaactgttctctccagactcagcatcacaagtttcaatccctccctttagaatctcagaaacagagaaaaatgaacttgagcctgattcactattaactgcagtgtctgcttcaggttattcctgcttttcagaagcagatgaggaagacattggatccacagctgctacacctgtatctgagcagttcagttcatcacagaagcaaaaagctgaaactttccctttgatgtctccgcttgaagacttaagtctgccgccttcaacagataaatcagagaaagcagaaattaagccagagattccaacaacctcaacatctgtatctgaatatctcattttggcacagaagcagaaaactcaagcatatttagagcctgagtctgaagacttgattccttcacatttaaccagtgaagtggagaagggagaaagggaggcaagttcatcagtagctgcaatacctgctgctttacctgcacaatcatctatagtaaaggaagaaaccaaacctgcatctccacattcagttttacctgattcagtccctgcaatcaagaaagaacaggaacccacagcagcactcactctaaaagctgcagatgaacagatggctttgtcaaaagtcagaaaggaagaaattgtgcctgattctcaagaagctacagcacatgtatcacaggatcaaaaaatggagcctcagcctccaaatgttccagagtctgagatgaaatattcagttttgcctgacatggtagatgagccaaagaagggtgtcaagcccaaattagttctaaatgtgacttctgaactagaacagagaaagttgtccaagaatgagcctgaagtaataaaaccatattcacctctaaaggaaacatctttatctggacctgaggctttatcagcagtgaaaatggagatgaaacatgattccaaaataacaactacacctatagtgcttcattcagcttcctcaggagtggaaaagcaagttgaacatggtccacctgcactagcattttcagctttgtcagaagaaattaaaaaagaaattgaacccagttcctcaacaactacagcatctgtaactaagcttgattcaaacttaaccagagcagtaaaagaagaaatcccaacagattcatctcttatcactcctgtagatcgtccagtcttaacaaaagtaggaaagggtgaattaggaagtggtttgccaccactggtaacatctgcagatgaacattcagttcttgcagaagaagacaaggtggcaattaaaggtgcttctcccattgaaacttcatccaaacatttagcttggtcagaagcagagaaggaaattaaatttgattcacttccaagtgtctcctctatagcagagcattctgttttgtcagaagtagaagccaaagaagttaaagctgggttgccagtaatcaaaacatcatcttctcagcattcagataaatctgaggaagcaagggtagaagacaaacaagatcttttattttctacagtctgtgactctgaacgtttggtttcatcacagaagaagagcttgatgtctacctcagaggtgttagagcctgaacatgagcttccactcagcctatggggtgagataaagaagaaagaaactgaacttccttcatcacaaaatgtgtcacctgcatccaaacatataatcccaaaaggcaaagatgaggaaacagcaagttcatctcctgagttggaaaatttagcatcaggtttagccccaacattactgctcctcagtgatgataagaacaaaccggcagtggaggtatcttctacagctcagggagacttcccatcagaaaaacaagatgttgctttggcagagctgtctttggaacctgagaagaaagacaagccacaccaaccgttggaattaccaaatgctgggtcagaattttctagtgatttaggtagacaaagtggatccataggtacaaaacaagcaaagtctcccataactgaaacagaggattctgttttagaaaaaggcccagctgagcttaggagcagagaaggaaaagaagaaaatagagagctttgtgcatcttctacgatgcctgcaatttcagagctttcatcattgcttagggaggaatctcagaatgaagaaattaaacctttctctcccaagatcatcagcctagagtcgaaagaaccacctgcctctgtagctgaaggaggcaacccagaagaatttcagccatttactttttctttaaaaggattatcagaggaggttagccatccagccgactttaaaaagggaggaaatcaagaaataggcccattaccaccaactggaaatttgaaggcacaagtcatgggagatattttagataagctaagtgaagaaacaggccacccaaattcatcccaggtactccagagtataacagaaccatcaaagattgctccttctgacctccttgtagaacaaaaaaagacagaaaaagcacttcattcagatcaaactgttaaattacctgatgtaagcacctcttctgaagataaacaagatctgggtattaagcagttttcacttatgagagagaatttgcctttggaacaatcaaaatcatttatgacaaccaagcctgcggatgtcaaagaaacaaaaatggaagaattctttatttctccaaaggatgaaaactggatgttgggaaagccagaaaatgtggctagtcaacacgaacagagaatagcaggatctgtgcagctggattcctctagcagcaatgagctgaggccagggcagctcaaggctgctgtgtccagtaaggaccatacatgtgaagtgagaaagcaggtcctgccgcattctgctgaagaatctcatttgtcatcacaagaagcagtatctgctcttgatacttccagtggtaatacagagaccttatcaagtaaaagttactcttctgaagaagtaaagctggctgaagaaccaaagtctttagtcctagctggaaatgtagagagaaacatagcagaggggaaggagattcattctttgatggagagtgaaagtttgctattggagaaagcaaacacagagctttcctggccttccaaagaagatagccaggaaaaaattaaactacctcctgaaagattcttccagaaaccagtgtctggcctatcagtggaacaggtgaagtcagaaacaatctcctcttctgtcaaaacagcccatttcccggcagaaggtgtggaacctgcattgggcaatgaaaaagaagcacacaggagcacacctccttttcctgaagagaagccattggaagaatcaaaaatggttcagtcaaaggttattgatgatgctgatgagggaaagaaaccatcacctgaagtaaaaatacccacacaaagaaaacccatctcctcaatccatgcaagagagcctcaatccccagagtcacctgaggtgacacaaaatccacctacacaaccaaaggtggctaagccggaccttcctgaggaaaagggaaagaaaggaatttcatctttcaaatcgtggatgtccagcttgttttttggatcgagcactccagataacaaagttgctgaacaagaagacttagaaacacagccaagtccatccgtagaaaaagcagtgactgtgatagatcctgaaggtacaattcccaccaattttaatgtagctgagaaaccagctgatcattcattatcagaggtaaaacttaaaactgctgatgaacccagaggtactttagtaaaatctggtgacggtcaaaacgttaaagaaaaatccatgattttatcaaatgtagaagatttacaacagccaaaattcatttctgaggtgtctagggaagattatggaaaaaaagaaatctcaggcgattcagaggaaatgaacataaactcagtagttacttctgctgatggtgagaaccttgaaattcaatcttattcactaatcggtgagaaattggttatggaagaagccaaaactattgttcctcctcatgttactgatagtaaaagagtccagaagccagcaatcgctcctccatctaaatggaatatttctatttttaaggaagagccaagaagtgatcaaaaacaaaaatcactcctttcatttgatgtagtagataaggtgccacaacagccaaaatcagcttcctccaactttgcaagtaaaaatatcacaaaggaatcagagaaaccagagtcaattattttgccagtagaagaatcaaaaggcagtttaattgatttcagtgaagacagactcaagaaagaaatgcaaaatcctacttccttgaaaatttctgaagaggaaacaaaactcaggtctgttagtccaactgagaagaaagataatttggaaaacagatcatataccttggcagaaaagaaggtgctggcagaaaaacaaaactctgtggccccattagagcttagagatagtaatgaaatagggaagacacaaattacacttggatctagatctactgaactgaaagaatcaaaagccgatgctatgccacagcacttctatcaaaatgaagactacaatgaaagacccaaaatcattgttggttctgaaaaggagaaaggtgaagaaaaagaaaatcaggtatatgtgctttcagaaggaaagaagcagcaggaacatcagccttattctgtgaatgtagccgagtctatgagtagagaatcagatatctctttaggtcattctttgggtgaaactcaatcattttcattagttaaagctacatcagttactgaaaaatcagaagccatgctcgcagaggctcacccagaaatcagagaagcaaaggcagtaggaacccaaccacatcctttagaagaaagtaaagttttggtggagaaaaccaagactttcctgccggtggctctttcttgtcgtgatgaaatagagaaccactctttatctcaggaaggaaatctagtattagaaaagtcaagcagagatatgccagatcacagtgaagaaaaagaacagttcagagagtcagagctatcgaaaggcggttcagtagatatcacaaaagaaactgtgaaacaaggatttcaagaaaaggcagtaggaacccaaccacgtcctttagaagaaagtaaagttttggtggagaaaactaagactttcctgccagtggttctttcttgtcatgatgaaatagagaaccactctttgtctcaggaaggaaatctagtgttagaaaagtcaagcagagatatgccagatcacagtgaagaaaaagaacagttcaaagagtcagagctatggaaaggtggttcagtagatatcacaaaagaaagtatgaaagaaggatttccatctaaagaatccgaaaggactttagctcgtccttttgatgaaactaagagctcagaaacaccgccatatttgctgtcacctgtaaaaccacaaactcttgcttcaggagcttctccagaaattaacgcagtgaagaaaaaagaaatgccacgatcagaattgactccagaaaggcatacagttcatactattcagacatctaaagatgacacatccgatgtgcctaaacaatctgttcttgtttcaaagcaccacttggaggctgcggaagatacccgtgtaaaggaaccactgtcttcagcaaaaagcaactatgctcaatttatatctaatacatcagcaagcaatgctgataaaatggtttctaataaagaaatgcccaaggaacctgaagacacatatgcaaaaggtgaagactttacagtgactagtaagccagccggactttcagaagatcagaagactgcctttagtatcatttctgaaggctgtgagatattgaatattcatgctccggcctttatttcttcaatcgatcaggaagaaagtgaacaaatgcaagataaattagaatatttggaagagaaagcctcatttaaaaccataccactccctgatgatagtgaaacagttgcttgtcataaaacattaaagagcaggttagaagatgaaaaagttaccccattgaaagaaaataaacaaaaggaaactcataagacaaaagaagagatatccacagattcagaaactgatttatcatttattcagcccacaattcccagtgaagaggattattttgaaaaatatactttgattgattataacatctccccagacccagaaaaacagaaagctccacagaaattaaatgttgaagagaaactctcaaaggaagttacagaagaaactatctctttcccagtaagttcagtggaaagtgcactagaacatgaatatgacttggtgaaattagatgaaagtttttatggaccagaaaagggccacaacatattatctcatccagagacccaaagccaaaactcagctgacaggaatgtttcaaaggacacaaagagagatgtggactcaaagtcaccggggatgcctttatttgaagcagaggaaggagttctatcacgaacccagatatttcctaccactattaaagtcattgatccagaatttctggaggagccacctgcacttgcatttttatataaggatctgtatgaagaagcagttggagagaaaaagaaggaagaggagacagcttctgaaggtgacagtgtgaattctgaggcatcatttcccagcagaaattctgacactgatgatggaacaggaatatattttgagaagtacatactcaaagatgacattctccatgacacatctctaactcaaaaggaccagggccaaggtctggaagaaaaacgagttggtaaggatgattcataccaaccgatagctgcagaaggggaaatttggggaaagtttggaactatttgcagggagaagagtctggaagaacagaaaggtgtttatggggaaggagaatcagtagaccatgtggagaccgttggtaacgtagcgatgcagaagaaagctcccatcacagaggacgtcagagtggctacccagaaaataagttatgcggttccatttgaagacacccatcatgttctggagcgtgcagatgaagcaggcagtcacggtaatgaagtcggaaatgcaagtccagaggtcaatctgaatgtcccagtacaagtgtccttcccggaggaagaatttgcatctggtgcaactcatgttcaagaaacatcactagaagaacctaaaatcctggtcccacctgagccaagtgaagagaggctccgtaatagccctgttcaggatgagtatgaatttacagaatccctgcataatgaagtggttcctcaagacatattatcagaagaactgtcttcagaatccacacctgaagatgtcttatctcaaggaaaggaatcctttgagcacatcagtgaaaatgaatttgcgagtgaggcagaacaaagtacacctgctgaacaaaaagagttgggcagcgagaggaaagaagaagaccaattatcatctgaggtagtaactgaaaaggcacaaaaagagctgaaaaagtcccagattgacacatactgttacacctgcaaatgtccaatttctgccactgacaaggtgtttggcacccacaaagaccatgaagtttcaacgcttgacacagctataagtgctgtaaaggttcaattagcagaatttctagaaaatttacaagaaaagtccttgaggattgaagcctttgttagtgagatagaatccttttttaataccattgaggaaaactgtagtaaaaatgagaaaaggctagaagaacagaatgaggaaatgatgaagaaggttttagcacagtatgatgagaaagcccagagctttgaggaagtgaagaagaagaagatggagttcctgcatgagcagatggtccactttctgcagagcatggacactgccaaagacaccctggagaccatcgtgagagaagcagaggagcttgatgaggccgtcttcctgacttcgtttgaggaaatcaatgaaaggttgctttctgcaatggagagcactgcttctttagagaaaatgcctgctgcgttttcccttttcgaacattatgatgacagctcggcaagaagtgaccagatgttaaaacaagtggctgttccacagcctcctagattagaacctcaggaaccaaattctgccaccagcacaacaattgcagtttactggagcatgaacaaggaagatgtcattgattcatttcaggtttactgcatggaggagccacaagatgatcaagaagtaaatgagttggtagaagaatacagactgacagtgaaagaaagctactgcatttttgaagatctggaacctgaccgatgctatcaagtgtgggtgatggctgtgaacttcactggatgtagcctgcccagtgaaagggccatctttaggacagcaccctccacccctgtgatccgcgctgaggactgtactgtgtgttggaacacagccactatccgatggcggcccaccaccccagaggccacggagacctacactctggagtactgcagacagcactctcctgagggagagggcctcagatctttctctggaatcaaaggactccagctgaaagttaacctccaacccaatgataactactttttctatgtgagggccatcaatgcatttgggacaagtgaacagagtgaagctgctctcatctccaccagaggaaccagatttctcttgttgagagaaacagctcatcctgctctacacatttcctcaagtgggacagtgatcagctttggtgagaggagacggctgacggaaatcccgtcagtgctgggtgaggagctgccttcctgtggccagcattactgggaaaccacagtcacagactgcccagcatatcgactcggcatctgctccagctcggctgtgcaggcaggtgccctaggacaaggggagacctcatggtacatgcactgctctgagccacagagatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctgtaaggcacaagtgatccttggctttcagaatttgcaagaacagcgatttgaattttgggggggtctgctgttcattcctttaggtgctatacattattcaaaaagtctcccgcgcatttgcactaatgatggctgcatgcatagcaatcagcatgtgagcaaaatcgacaagaaaaccttgactttacagagcagtgtgtgagtaaacagaatgaaaacaacaacctccactctttagtttatataagtttgagttctttcctaaattaaaagatctacacttgagttgggaaccgaaagagaaaaatggacttccatctgttttactggtaaaggaaatcctctgatggacaggtcagagtgaaggaaggttgtgctggtaagacatctctgacgaagagccatggatgctttccacaaaatgtcacctcgctgcactaaaggatgatgaatcctaatcattaaaggaattgtttcagctgatttaaatttataatgaactcttttgtaataatgtatactgtagaacatgagtctctcctccctaaaattttaaatgtagaaaagtgctatatattagaaatttccattttgttaaataaatggttagagtctataaa

SEQ ID NO: 114420 - DNA, 1664 bp, Homo sapiens
  Payload ID: 2368
  Gene Symbol: CTF1
  Gene Name: cardiotrophin 1
  Uniprot ID: Q16619
  ENST ID: ENST00000279804
  CDS Start-End: 38-643
ggggcgtgaagggagccgggatcagccaggggccagcatgagccggagggagggaagtctggaagacccccagactgattcctcagtctcacttcttccccacttggaggccaagatccgtcagacacacagccttgcgcacctcctcaccaaatacgctgagcagctgctccaggaatatgtgcagctccagggagaccccttcgggctgcccagcttctcgccgccgcggctgccggtggccggcctgagcgccccggctccgagccacgcggggctgccagtgcacgagcggctgcggctggacgcggcggcgctggccgcgctgcccccgctgctggacgcagtgtgtcgccgccaggccgagctgaacccgcgcgcgccgcgcctgctgcgccgcctggaggacgcggcgcgccaggcccgggccctgggcgccgccgtggaggccttgctggccgcgctgggcgccgccaaccgcgggccccgggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctgagcgccgcggggcagctcgccccgcctcctcccgctgggttccgtctctccttccgcttctttgtctttctctgccgctgtcggtgtctgtctgtctgctcttagctgtctccattgcctcggccttctttgctttttgtgggggagaggggaggggacgggcagggtctctgtcgcccaggctggggtgcagtggcgcgatcccagcactgcagcctcaacctcctgggctcaagccatccttccgcctcagcttccccagcagctgggactacaggcacgcgccaccacagccggctaattttttatttaattttttgtagagacgaggtttcgccatgttgcccaggctggtcttgaactccggggctcaagcgatcctcccgcttcagcctccctaagtgctgggattgcaggcgtgagccactttcccagcctctctttgctttgcctgccccgttctcttaactcttggaccctcctcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatctggctgtctctctgtgcttccctggccaggggcgtgcctgctggtcctatggggggaaggctactctgcatctcagccaccttcctcaggctcactccacctacatccccagtctgccacaccccatccctttgggcctcagccctgtccctttgatgtcctcctttccttcagcccctctgccctgtccctgcacacctccactgcctcccagcagatctgtggagacaaaacaagcaacaccttaaaagagttttatttctgaaaataaattaattttttgtaaataaaatgtttaaaaataaaaaagaaactaaagtta

SEQ ID NO: 114421 - DNA, 1617 bp, Homo sapiens
  Payload ID: 2368
  Gene Symbol: CTF1
  Gene Name: cardiotrophin 1
  Uniprot ID: Q16619
  ENST ID: ENST00000395019
  CDS Start-End: 7-609
gccagcatgagccggagggagggaagtctggacccccagactgattcctcagtctcacttcttccccacttggaggccaagatccgtcagacacacagccttgcgcacctcctcaccaaatacgctgagcagctgctccaggaatatgtgcagctccagggagaccccttcgggctgcccagcttctcgccgccgcggctgccggtggccggcctgagcgccccggctccgagccacgcggggctgccagtgcacgagcggctgcggctggacgcggcggcgctggccgcgctgcccccgctgctggacgcagtgtgtcgccgccaggccgagctgaacccgcgcgcgccgcgcctgctgcgccgcctggaggacgcggcgcgccaggcccgggccctgggcgccgccgtggaggccttgctggccgcgctgggcgccgccaaccgcgggccccgggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctgagcgccgcggggcagctcgccccgcctcctcccgctgggttccgtctctccttccgcttctttgtctttctctgccgctgtcggtgtctgtctgtctgctcttagctgtctccattgcctcggccttctttgctttttgtgggggagaggggaggggacgggcagggtctctgtcgcccaggctggggtgcagtggcgcgatcccagcactgcagcctcaacctcctgggctcaagccatccttccgcctcagcttccccagcagctgggactacaggcacgcgccaccacagccggctaattttttatttaattttttgtagagacgaggtttcgccatgttgcccaggctggtcttgaactccggggctcaagcgatcctcccgcttcagcctccctaagtgctgggattgcaggcgtgagccactttcccagcctctctttgctttgcctgccccgttctcttaactcttggaccctcctcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatctggctgtctctctgtgcttccctggccaggggcgtgcctgctggtcctatggggggaaggctactctgcatctcagccaccttcctcaggctcactccacctacatccccagtctgccacaccccatccctttgggcctcagccctgtccctttgatgtcctcctttccttcagcccctctgccctgtccctgcacacctccactgcctcccagcagatctgtggagacaaaacaagcaacaccttaaaagagttttatttctgaaaataaattaattttttgtaaataaaatgtttaaaaataaaaaa

SEQ ID NO: 114422 - DNA, 1844 bp, Homo sapiens
  Payload ID: 2369
  Gene Symbol: CLCF1
  Gene Name: cardiotrophin-like cytokine factor 1
  Uniprot ID: Q9UBD9
  ENST ID: ENST00000312438
  CDS Start-End: 199-876
acacgtcagaaaaaaaaaaaaaaagtttgcagaatgtcccacaccgaaaaaaaaaaaaaatccgaaaccgagcgaaaaaaacctgcgagtgggcctggcggatgggattattaaagcttcgccggagccgcggctcgccctcccactccgccagcctccgggagaggagccgcacccggccggcccggccccagccccatggacctccgagcaggggactcgtgggggatgttagcgtgcctgtgcacggtgctctggcacctccctgcagtgccagctctcaatcgcacaggggacccagggcctggcccctccatccagaaaacctatgacctcacccgctacctggagcaccaactccgcagcttggctgggacctatctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcctctggccctttcctggaccggctgggcgtgtgatgcgatcagccctgtctcctccccacctcccaaaggtctaccgagctggggaggaggtacagtaggccctgtcctgtcctgtttctacaggaagtcatgctcgagggagtgtgaagtggttcaggttggtgcagaggcgctcatggcctcctgcttcttgcctaccacttggccagtgcccacccagcccctcaggtggcacatctggagggcaggggttgaggggccaccaccacacatgcctttctggggtgaagccctttggctgccccactctccttggatgggtgttgctcccttatccccaaatcactctatacatccaattcaggaaacaaacatggtggcaattctacacaaaaagagatgagattaacagtgcagggttggggtctgcattggaggtgccctataaaccagaagagaaaatactgaaagcacaggggcagggacagaccagaccagacccaggagtctccaaagcacagagtggcaaacaaaacccgagctgagcatcaggaccttgcctcgaattgtcttccagtattacggtgcctcttctctgccccctttcccagggtatctgtgggttgccaggctggggagggcaaccatagccacaccacaggatttcctgaaagtttacaatgcagtagcattttggggtgtagggtggcagctccccaaggccctgccccccagccccacccactcatgactctaagtgtgttgtattaatatttatttatttggagatgttatttattagatgatatttattgcagaatttctattcttgtattaacaaataaaatgcttgccccagaa

SEQ ID NO: 114423 - DNA, 967 bp, Homo sapiens
  Payload ID: 2369
  Gene Symbol: CLCF1
  Gene Name: cardiotrophin-like cytokine factor 1
  Uniprot ID: Q9UBD9
  ENST ID: ENST00000533438
  CDS Start-End: 146-793
acttgctcccaggccagctcgctggcatttgggagaatgtgtcattgcatttactcaagggggaggaggagggaaggttagagatgaggaggcagaggtagggtgggagcagggacctcgcacaggcagaggggactcgtgggggatgttagcgtgcctgtgcacggtgctctggcacctccctgcagtgccagctctcaatcgcacaggggacccagggcctggcccctccatccagaaaacctatgacctcacccgctacctggagcaccaactccgcagcttggctgggacctatctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcctctggccctttcctggaccggctgggcgtgtgatgcgatcagccctgtctcctccccacctcccaaa

SEQ ID NO: 114424 - DNA, 2763 bp, Homo sapiens
  Payload ID: 2370
  Gene Symbol: CRAT
  Gene Name: carnitine O-acetyltransferase
  Uniprot ID: P43155
  ENST ID: ENST00000318080
  CDS Start-End: 296-2176
atcgatgccccgtccccgccccacagccaacctcccgggcaccgttgcccgcccggggcccgctaccggcccaggccccgcctcgcgagtcctcctccccgggtgccttcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccctggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggg

SEQ ID NO: 114425 - DNA, 973 bp, Homo sapiens
  Payload ID: 2370
  Gene Symbol: CRAT
  Gene Name: carnitine O-acetyltransferase
  ENST ID: ENST00000393384
  CDS Start-End: 203-688
cctccccgggtgccttcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactgggtgagtgagggcatcctcactgtgacctgctgctggctgcacatgcacagttctccagtgcccactgctctggcacggccgttcgtttgctgcccagagtttcgtgagcacatactctgtgtctggcacttggcagggtgctgggtgatcaagaaggacacagtcaccagctccttggagctaacattcaagtagggaggagagaaaggtaatgaacaggatacaggttgtggacaaggtttcatgttccaggacagaggcaggagtggggtgcacggcaggtacaaccagatagaagatgcccttgtgcttggtgggacagcctcaggcaggggatatgtgtcactcagtgaccgatcgcccaggttctgtatctgatctatgacacaggtgtacccagtttggcaaatatgtctacaccaatgtttggtgtgcttttctatttgcatctcatacttcaatacacagatttaaaaagtg

SEQ ID NO: 114426 - DNA, 595 bp, Homo sapiens
  Payload ID: 2370
  Gene Symbol: CRAT
  Gene Name: carnitine O-acetyltransferase
  ENST ID: ENST00000455830
  CDS Start-End: 302-595
ggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtgcccaggcaagtggctgcctctggctaggttctgctcactcactttgtagcacagttaggcttagagatccagccaaggcagacagacagggcccagaacctcagtcctgccatggaggaggacgggcagcagagagagaaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactgg

SEQ ID NO: 114427 - DNA, 800 bp, Homo sapiens
  Payload ID: 2370
  Gene Symbol: CRAT
  Gene Name: carnitine O-acetyltransferase
  ENST ID: ENST00000415948
  CDS Start-End: 1-95
accgatcccagggctgtggtgtaacctcagcggccaggcagtctctgtcctccagccaagttttccctcatcaaaacgatcttcgcagattctgacagcccaggcaagtggctgcctctggctaggttctgctcactcactttgtagcacagttaggcttagagatccagccaaggcagacagacagggcccagaacctcagtcctgccatggaggaggacgggcagcagagagagaaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagacc

SEQ ID NO: 114428 - DNA, 795 bp, Homo sapiens
  Payload ID: 2370
  Gene Symbol: CRAT
  Gene Name: carnitine O-acetyltransferase
  ENST ID: ENST00000455396
  CDS Start-End: 1-604
catgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatccc

SEQ ID NO: 114429 - DNA, 2253 bp, Homo sapiens
  Payload ID: 2370
  Gene Symbol: CRAT
  Gene Name: carnitine O-acetyltransferase
  ENST ID: ENST00000458362
  CDS Start-End: 274-396
acagccaacctcccgggcaccgttgcccgcccggggcccgctaccggcccaggccccgcctcgcgagtcctcctccccgggtgccttcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggaccgatcccagggctgtggtgtaacctcagcggccaggcagtctctgtcctccagccaagttttccctcatcaaaacgatcttcgcagattctgacaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccctggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctga

SEQ ID NO: 114430 - DNA, 831 bp, Homo sapiens
  Payload ID: 2370
  Gene Symbol: CRAT
  Gene Name: carnitine O-acetyltransferase
  ENST ID: ENST00000441796
  CDS Start-End: 261-383
cgggcaccgttgcccgcccggggcccgctaccggcccaggccccgcctcgcgagtcctcctccccgggtgccttcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggaccgatcccagggctgtggtgtaacctcagcggccaggcagtctctgtcctccagccaagttttccctcatcaaaacgatcttcgcagattctgacagggtgggagaaaaggacgtggggacctccaagagggacagtcaccactctgctggctggctcctcttccagggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcaggg

SEQ ID NO: 114431 - DNA, 3175 bp, Homo sapiens
  Payload ID: 2371
  Gene Symbol: CROT
  Gene Name: carnitine O-octanoyltransferase
  Uniprot ID: Q9UKG9
  ENST ID: ENST00000331536
  CDS Start-End: 186-2024
gggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataactcttttgaacaaacagacaaattagctagtagtatggagatgtataccctctattacacacataaaaccgtaacaaaattcattgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctgtttg

SEQ ID NO: 114432 - DNA, 1213 bp, Homo sapiens
  Payload ID: 2371
  Gene Symbol: CROT
  Gene Name: carnitine O-octanoyltransferase
  Uniprot ID: Q9UKG9
  ENST ID: ENST00000412227
  CDS Start-End: 188-451
gggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattgggtatttgttgttataattgaataatgatgatgtttaaagaatgataaataaaaagtgcatagtttttatttttaaattattgctgtaaaaatttttacagttattattgttattttcataatccaaaagaaggaatgaatcacttaactttgggagttttcagtgggtggattcgggaacttgttaaaatgcagatttgctgggataagtgattctgattcacatggctggaatgaggcccagagattcttattttaacaatcacttcatgtggtttggctgcaggtaatctgtagaccatgctgaaggaaaacattttgtccaggtgactagcttgaaaaatcagaaacactaaaatagacatgtcacataggtggcatagaaatattttcgtagtacaatggagaaagggaatcattaaaaatcagagtggagaatggttatgtatattgtatatttcagttagataaattgaggaagctagtataataattattgaaggtctcaataattttccacaaaattctttaacttcttcagctcaaccatttctgtacttctctactatgaatcagaggatgaggttgtataattcaaaagcattgccttagtctagaaataattattgtacctatcatttagttttagaaataaaaagcaagctgattttttttgatgaaccatttatatctgtgatggaataataaaatttcacacttccggattcctttgttctcaattttgagccttgagttgttttaattaaagaggggtaaaggtaaagaa

SEQ ID NO: 114433 - DNA, 1993 bp, Homo sapiens
  Payload ID: 2371
  Gene Symbol: CROT
  Gene Name: carnitine O-octanoyltransferase
  ENST ID: ENST00000442291
  CDS Start-End: 118-1842
cacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtgctagtcatctaatgaatgaggtgtttcttagcattatctacagatatggctttaccttcaattgtgtcaggttacatttacctaatgtcagcaagacttcacatttcatgtatgaatatccagatgaaataaagtcctggttgtattcaccatca

SEQ ID NO: 114434 - DNA, 2959 bp, Homo sapiens
  Payload ID: 2371
  Gene Symbol: CROT
  Gene Name: carnitine O-octanoyltransferase
  Uniprot ID: Q9UKG9
  ENST ID: ENST00000419147
  CDS Start-End: 200-2122
tttgaggcccaagggggagcgagccggtgctgctgcaggctgaggctgcggcagaggcggcgaggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaattggctaaatcaactgaagaacgaacatttcagtaccaggattctcttccatcactgcctgttccttcacttgaagaatcattaaaaaaataccttgaatcagtcaccagaacatgctaccagataaggggtcttgatccagatgctaagagagggttcttggatctcacgcgggaaggaattcaagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaag

SEQ ID NO: 114435 - DNA, 5232 bp, Homo sapiens
  Payload ID: 2372
  Gene Symbol: CPT1A
  Gene Name: carnitine palmitoyltransferase 1A (liver)
  Uniprot ID: P50416
  ENST ID: ENST00000265641
  CDS Start-End: 156-2477
aatccgctgctgccggcgtcgggtgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgtttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagcccaccgtggtgaggagagagtggctccacgaccccaagggatggccttctcctcccacccggtgaggggaaagactcaccagagggtgatggagacagtatgccggctcaccttggtgaccagccaagatgtctcaagtgacagtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagtttcactcttgttgcccaggctggagtgcagtggtgcaatctcggctcactgcagcatctgccttgcaggttcaagcgattctcctgtctcagcctcccaagtagctgggattacacgcccaacaccatgccctgctaatttttgtatttttagtagagacggggtttcatcatattggtcaggctggtctcgaactcctgacctcaggtgatccacctgcctcagcctcccaaagtgctgggattacaggcatgagccaccatgcgcggcccacatgcatgttttatgtatgtatacttcatgatgtaaaaatcccacctttatgggccaaagattttttttctcctgaaagcaagaaaaaatgaaaacaaaagacaaaaaaaaaaaaaaaagcgtccaggcgcggtggctcatgcgtgtaatcccagcactttgggaggccaaggcgggcggatcacgaggtcaggagatggagaccatcctggctaacacggtgaaaccccgtctctactaaaaattcaaaaaatgagccgggcgtggtggcgggcgcctgtagtcccagctactcaggaggctgaggcaggagaatggcgtgaacccgggaggcggagcttgcagtgagccgagatcgctccactgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtcta

SEQ ID NO: 114436 - DNA, 2635 bp, Homo sapiens
  Payload ID: 2372
  Gene Symbol: CPT1A
  Gene Name: carnitine palmitoyltransferase 1A (liver)
  Uniprot ID: P50416
  ENST ID: ENST00000376618
  CDS Start-End: 171-2441
ggacccgcctcagccaatccgctgctgccggcgtcgggtgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggggattataagtcaaggaccaagttcagatacttgagacaaagtggaaagtctcagcatatggaaacaaggccttggaggagaccatggacatcaccaagttcatgtgctgggctggaaagaaaagcctgttgattttcacttgctgtgcatttattcatccattccattgcctcaatgctgagaacagtgcctgacacataaaagatgctcaataaatatgttaaaagt

SEQ ID NO: 114437 - DNA, 2496 bp, Homo sapiens
  Payload ID: 2372
  Gene Symbol: CPT1A
  Gene Name: carnitine palmitoyltransferase 1A (liver)
  Uniprot ID: P50416
  ENST ID: ENST00000540367
  CDS Start-End: 30-2300
ctccttctccttccaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggggattataagtcaaggaccaagttcagatacttgagacaaagtggaaagtctcagcatatggaaacaaggccttggaggagaccatggacatcaccaagttcatgtgctgggctggaaagaaaagcctgttgattttcacttgctgtgcatttattcatccattccattgcctcaatgctgagaacagtgcctgacacataaaagatgctcaataaatatgttaaaagtaa

SEQ ID NO: 114438 - DNA, 2382 bp, Homo sapiens
  Payload ID: 2372
  Gene Symbol: CPT1A
  Gene Name: carnitine palmitoyltransferase 1A (liver)
  Uniprot ID: P50416
  ENST ID: ENST00000539743
  CDS Start-End: 30-2351
ctccttctccttccaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttctttgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgag

SEQ ID NO: 114439 - DNA, 617 bp, Homo sapiens
  Payload ID: 2372
  Gene Symbol: CPT1A
  Gene Name: carnitine palmitoyltransferase 1A (liver)
  ENST ID: ENST00000538994
  CDS Start-End: 103-339
ccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacgatctgccttgatcagctgtcactgtgcatccccactgagcagtgcttaagaggacttgataaatattcgtggagtgaacgtacttcatcacatttctgtgatgtttaagcttactgaggagcttaaattactctgttttagtagtttttacggaatggcttggtttcgtaattttccactttctttctcagaacatttctcgggttctcagaaacaattatcggaatgtttctcagcatattttctaagttgccctattgtcattaattaataaaaagttactatacgg

SEQ ID NO: 114440 - DNA, 499 bp, Homo sapiens
  Payload ID: 2372
  Gene Symbol: CPT1A
  Gene Name: carnitine palmitoyltransferase 1A (liver)
  ENST ID: ENST00000569129
  CDS Start-End: 147-499
agacgcgccctgggctcttgagcgcggtgcctgcgtttctggctcgttggatgcagcatctgtcatcagaagcactgagcaccgagctgtccccacagctgggcaccgcagggctcgaccttcccacggagaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccct

SEQ ID NO: 114441 - DNA, 559 bp, Homo sapiens
  Payload ID: 2372
  Gene Symbol: CPT1A
  Gene Name: carnitine palmitoyltransferase 1A (liver)
  ENST ID: ENST00000561996
  CDS Start-End: 280-559
gagaaagattactctagtttcagaggcagacatggagacgtttttggccccagggaactgaggctcaggcccggagctccccgggaggcctcgttctctgcttctttattaatagactcagctacgcagccgcgggagccgcagacccgggcaggagagctgcagcgtggtcggcgggaggggaataaggcctccccagtgcggctgcagttgcaggccggcgcgggctcgttgcagctgccgagagcccggccaccatggcacaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacgg

SEQ ID NO: 114442 - DNA, 511 bp, Homo sapiens
  Payload ID: 2372
  Gene Symbol: CPT1A
  Gene Name: carnitine palmitoyltransferase 1A (liver)
  ENST ID: ENST00000565318
  CDS Start-End: 108-511
gagacggggtttcgccatgttgcccaggctggtcttgagttcctggactcaagcgatcctcccacgtcagcctcccaaagtgctgggattacaggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtg

SEQ ID NO: 114443 - DNA, 2592 bp, Homo sapiens
  Payload ID: 2373
  Gene Symbol: CPT1B
  Gene Name: carnitine palmitoyltransferase 1B (muscle)
  Uniprot ID: Q92523
  ENST ID: ENST00000312108
  CDS Start-End: 52-2370
gccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttc

SEQ ID NO: 114444 - DNA, 2319 bp, Homo sapiens
  Payload ID: 2373
  Gene Symbol: CPT1B
  Gene Name: carnitine palmitoyltransferase 1B (muscle)
  Uniprot ID: Q92523
  ENST ID: ENST00000360719
  CDS Start-End: 1-2319
atggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctga

SEQ ID NO: 114445 - DNA, 2662 bp, Homo sapiens
  Payload ID: 2373
  Gene Symbol: CPT1B
  Gene Name: carnitine palmitoyltransferase 1B (muscle)
  Uniprot ID: Q92523
  ENST ID: ENST00000395650
  CDS Start-End: 90-2408
aggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctc

SEQ ID NO: 114446 - DNA, 2647 bp, Homo sapiens
  Payload ID: 2373
  Gene Symbol: CPT1B
  Gene Name: carnitine palmitoyltransferase 1B (muscle)
  Uniprot ID: Q92523
  ENST ID: ENST00000405237
  CDS Start-End: 106-2424
gtcgcggactggctgggggcgtctcggcgcggctggcggcggggccggcctaagcgcgcccgcgcacccatctgcccccgtcctaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttca

SEQ ID NO: 114447 - DNA, 719 bp, Homo sapiens
  Payload ID: 2373
  Gene Symbol: CPT1B
  Gene Name: carnitine palmitoyltransferase 1B (muscle)
  ENST ID: ENST00000423069
  CDS Start-End: 1-279
ctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacaggattgttggtgttgcgtgagagagagtggaagcacccagcacagggcctggtttaggacacacggatcccatccagggggcaggaaggcccaggcagaggccgagcaaaacaggatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacag

SEQ ID NO: 114448 - DNA, 558 bp, Homo sapiens
  Payload ID: 2373
  Gene Symbol: CPT1B
  Gene Name: carnitine palmitoyltransferase 1B (muscle)
  ENST ID: ENST00000417176
  CDS Start-End: 183-558
acttccaggggcgcctctctcccctgcccgcgccctcgctgacgccccccaactccaggctgcccttcgccgtccttggggctcctggagctttcaaggcccaaatcccctgcaccacagtggctgtgcccacccggaaggctggcgcgaggatttggcggcggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgcc

SEQ ID NO: 114449 - DNA, 2217 bp, Homo sapiens
  Payload ID: 2373
  Gene Symbol: CPT1B
  Gene Name: carnitine palmitoyltransferase 1B (muscle)
  Uniprot ID: Q92523
  ENST ID: ENST00000457250
  CDS Start-End: 1-2217
atggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggcttacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctga

SEQ ID NO: 114450 - DNA, 2783 bp, Homo sapiens
  Payload ID: 2374
  Gene Symbol: CPT1C
  Gene Name: carnitine palmitoyltransferase 1C
  Uniprot ID: Q8TCG5
  ENST ID: ENST00000323446
  CDS Start-End: 246-2657
ggacctgaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 114451 - DNA, 2910 bp, Homo sapiens
  Payload ID: 2374
  Gene Symbol: CPT1C
  Gene Name: carnitine palmitoyltransferase 1C
  Uniprot ID: Q8TCG5
  ENST ID: ENST00000392518
  CDS Start-End: 373-2784
gaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcaggtgcttagagaaggatgagctaggttatgtagtcctgggtcggcgcaaaaaggcagctgaaagcggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 114452 - DNA, 2785 bp, Homo sapiens
  Payload ID: 2374
  Gene Symbol: CPT1C
  Gene Name: carnitine palmitoyltransferase 1C
  Uniprot ID: Q8TCG5
  ENST ID: ENST00000405931
  CDS Start-End: 281-2659
ggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 114453 - DNA, 1059 bp, Homo sapiens
  Payload ID: 2374
  Gene Symbol: CPT1C
  Gene Name: carnitine palmitoyltransferase 1C
  ENST ID: ENST00000598396
  CDS Start-End: 289-1059
gagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatg

SEQ ID NO: 114454 - DNA, 620 bp, Homo sapiens
  Payload ID: 2374
  Gene Symbol: CPT1C
  Gene Name: carnitine palmitoyltransferase 1C
  ENST ID: ENST00000596922
  CDS Start-End: 208-414
tcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggggtcttacttactttgttacccaggctggagtgcagtgtcaccatcacagctcacttcatccctgaactcctgggctcaagcgatcctcctgcttcagccttccaagtagctgggactaagaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaac

SEQ ID NO: 114455 - DNA, 503 bp, Homo sapiens
  Payload ID: 2374
  Gene Symbol: CPT1C
  Gene Name: carnitine palmitoyltransferase 1C
  ENST ID: ENST00000594038
  CDS Start-End: 184-390
aggagactaagagacaatgagctgagtgaggagcccaggaacccgggttccgaacagctgcgtagaatgcgagcggccaaatggtggagaatctggccggaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggggtcttacttactttgttacccaggctggagtgcagtgtcaccatcacagctcacttcatccctgaactcctgggctcaagcgatcctcctgcttcagccttccaagtagctgggactaagaatgactttctcaccggtgtgtttcctgccagccccctcagttggcttttcctcttca

SEQ ID NO: 114456 - DNA, 754 bp, Homo sapiens
  Payload ID: 2374
  Gene Symbol: CPT1C
  Gene Name: carnitine palmitoyltransferase 1C
  ENST ID: ENST00000594587
  CDS Start-End: 222-754
ccctcgccttggcatgaaaagcggcaatggggtggacagcgtcaatgtctaacaggtgtttgtttcatatgggtctaaaactaatgcttttctcaagaccccgcaactcagcctggaccagtttccctcctccacccacccccgaatcttgagaatcctgtactggggggagggcactgcccccgcaccatgttcttgggagagcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctc

SEQ ID NO: 114457 - DNA, 310 bp, Homo sapiens
  Payload ID: 2374
  Gene Symbol: CPT1C
  Gene Name: carnitine palmitoyltransferase 1C
  ENST ID: ENST00000597099
  CDS Start-End: 1-246
gtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacagcaggcagctggcctctccaaggaataagggtgaaattgccacagctggctgacacaggacaggggcaactggtttggcaaccccacatccaggccaataaagatgtgtgagctggg

SEQ ID NO: 114458 - DNA, 586 bp, Homo sapiens
  Payload ID: 2374
  Gene Symbol: CPT1C
  Gene Name: carnitine palmitoyltransferase 1C
  ENST ID: ENST00000595969
  CDS Start-End: 197-586
aatggggtggacagcgtcaatgtctaacaggtgtttgtttcatatgggtctaaaactaatgcttttctcaagaccccgcaactcagcctggaccagtttccctcctccacccacccccgaatcttgagaatcctgtactggggggagggcactgcccccgcaccatgttcttgggagagcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggccctggtccgcatcttctctggccgccacccgatgctgttcagttaccagcgctccctgccacgccagcccgtgccctctgtgcaggacaccgtgcgcaagtacctgg

SEQ ID NO: 114459 - DNA, 1137 bp, Homo sapiens
  Payload ID: 2374
  Gene Symbol: CPT1C
  Gene Name: carnitine palmitoyltransferase 1C
  ENST ID: ENST00000595031
  CDS Start-End: 1-1011
ctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacaggacaggggcaactggtttggcaaccccacatccaggccaataaagatgtgtgagctggg

SEQ ID NO: 114460 - DNA, 2679 bp, Homo sapiens
  Payload ID: 2374
  Gene Symbol: CPT1C
  Gene Name: carnitine palmitoyltransferase 1C
  ENST ID: ENST00000598259
  CDS Start-End: 354-560
acctgaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaccccgcaactcagcctggaccagtttccctcctccacccacccccgaatcttgagaatcctgtactggggggagggcactgcccccgcaccatgttcttgggagagcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggggtcttacttactttgttacccaggctggagtgcagtgtcaccatcacagctcacttcatccctgaactcctgggctcaagcgatcctcctgcttcagccttccaagtagctgggactaagaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagc

SEQ ID NO: 114461 - DNA, 599 bp, Homo sapiens
  Payload ID: 2374
  Gene Symbol: CPT1C
  Gene Name: carnitine palmitoyltransferase 1C
  ENST ID: ENST00000602019
  CDS Start-End: 313-599
gtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaccccgcaactcagcctggaccagtttccctcctccacccacccccgaatcttgagaatcctgtactggggggagggcactgcccccgcaccatgttcttgggagagcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtgg

SEQ ID NO: 114462 - DNA, 2767 bp, Homo sapiens
  Payload ID: 2374
  Gene Symbol: CPT1C
  Gene Name: carnitine palmitoyltransferase 1C
  Uniprot ID: Q8TCG5
  ENST ID: ENST00000598293
  CDS Start-End: 289-2700
gagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtgaggtcccgaattgacgtccttccctcaaaacctccgggtctacaaaccaggaccctcaagacccttcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacggacccacagtgcctcgccctgttccgcgtggcagtggacaagcaccaggctctgctgaaggcagccatgagcgggcagggagttgaccgccacctgtttgcgctgtacatcgtgtcccgattcctccacctgcagtcgcccttcctgacccaggtccattcggagcagtggcagctgtccaccagccagatccctgttcagcaaatgcatctgtttgacgtccacaattacccggactatgtttcctcaggcggtggattcgggcctgctgatgaccatggttatggtgtttcttatatcttcatgggggatggcatgatcaccttccacatctccagcaaaaaatcaagcacaaaaacggattcccacaggctggggcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactccttccagcaggcagctggcctctccaaggaataagggtgaaattgccacagctggctgacacag

SEQ ID NO: 114463 - DNA, 830 bp, Homo sapiens
  Payload ID: 2374
  Gene Symbol: CPT1C
  Gene Name: carnitine palmitoyltransferase 1C
  ENST ID: ENST00000595568
  CDS Start-End: 42-260
ggggtggacagcgtcaatgtctaacagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggtgccatccagcttgcctggttcctccagctggatccttccttaggactgatggagaagatcaaagagttgctgcctgactggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccga

SEQ ID NO: 114464 - DNA, 3094 bp, Homo sapiens
  Payload ID: 2375
  Gene Symbol: CPT2
  Gene Name: carnitine palmitoyltransferase 2
  Uniprot ID: P23786
  ENST ID: ENST00000371486
  CDS Start-End: 516-2492
ctcatatctagaattttgggaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcagcgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccgtccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttgaa

SEQ ID NO: 114465 - DNA, 2215 bp, Homo sapiens
  Payload ID: 2376
  Gene Symbol: CNDP1
  Gene Name: carnosine dipeptidase 1 (metallopeptidase M20 family)
  Uniprot ID: Q96KN2
  ENST ID: ENST00000358821
  CDS Start-End: 229-1752
gcattgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaactcgggagaatggctgcgtccctgctggctgtgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttcaaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctccaccactgactacaa

SEQ ID NO: 114466 - DNA, 4111 bp, Homo sapiens
  Payload ID: 2376
  Gene Symbol: CNDP1
  Gene Name: carnosine dipeptidase 1 (metallopeptidase M20 family)
  ENST ID: ENST00000582365
  CDS Start-End: 67-1461
gggactccctctgccacattttttggaggttgggaaagttgctagaggcttcagaactccagcctaatggatcccaaactcgggagaatgacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccgtcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtggaactacatagagggaaccaaattatttgctgcctttttcttagagatggcccagctccattaatcacaagaaccttctagtctgatctgatccactgacagattcacctcccccacatccctagacagggatggaatgtaaatatccagagaatttgggtctagtatagtacattttcccttccatttaaaatgtcttgggatatctggatcagtaataaaatatttcaaaggcacagatgttggaaatggtttaaggtcccccactgcacaccttcctcaagtcatagctgcttgcagcaacttgatttccccaagtcctgtgcaatagccccaggattggattccttcaaaccttttagcatatctccaaccttgcaatttgattggcataatcactccagtttgctttctaggtcctcaagtgctcgtgacacataatcattccatccaatgatcgcctttgctttaccactctttccttttatcttattaataaaaatgttggtctccaccactgactacaatgatttccccatggattcattttcagaggagttactaaggcatggtactatattaacctcttgcctccccttcatttattttttcccacttcttgaaaagttccgaagctgaaatgatcaatattcatacccatatgccatttgggagtccttgtgcaaagatgagtatttttttttttattccaagcttctttacctttcctgagatcgatgccaccttgtcagcttctctgcctcccgttccttcttcctgtcccatcagaaaaggcccactctctctctatccaacatctgtgcacaggttgcaccagagcagaatttatcctgatagaatttctctcaccccattgaagttttactcaatgacaacatctaaattgctcaaagcttttaatagcatcagttttagatagagaactaatcaaccctgacatcagtaacacacgctaaatttaaagccatcagctaatgctgcattcattaatcattttagttaaccatcatgtttggcttgattggatttgacggtgtaaacaacaaaaaaagacagtcatttttctacagttgagtgtatataaacaaaatcaatctttatgaatttattatttaaatcacattaatggagaatcatttaggggcttattaaaatttttttctattatgactccaaataaaaacaaagcagagggccaggcgcggtggctcatgcccataatcccagcactttcggaggccgaggtgggcggatcacctgaggtcgggagttcgagatcagcctggctaacatggtgaaaccctgtctctactgaatatacaaaattaactgggcatggtggtgcatgcctgtagtcccagctactcgggaggctgaggcaggagaatcgcttgaacccaggaggcggaagttgcagtgaactgggatcatgccactgcactccagcctgggcgacagagtgagactccgtctccaaaaaaaaaaaaaaaaaaaaaaaaagcagaacacatttgcgttcaacttttttccatcactctgttggttcttgagatgtcagtgtcagtttaaaaacgtgctgtaccacctttaaaaggactggagcaggcaggcagtgattcagttcaccttgactctagtcatagaagtggacccaactgagagctcaacctagttgtgggcatttgtgaaggattccagttagtgttttctttggaagcaggaggcttcaagccatcacatctccaattctatagaatatcaagtcatcgttaaagaacagcagcaggtgtttgatattttgtgctattaagtgtagtttgcgctcatctaattatgcagagtttcgtggtgtttctcgattttgttgaacctacctgatgcatttggcactgtagataaggactaacagtaagagagatttagagtcttcatgttagtccattaacataagtttattataaaatacactgtaagcatttctggctaatgtaccatcagatttaagaagttacccaacaatatgtattcgctgatcttcattcctgctgaatctgagaccagcagtgtctcaattattacgttgctgccaggagagaaggggaggagaatgaatagttatggaagttgtagaatctaggatattccaaccctggattgccagagttcagagtccatgtttttctgtcacccagggtcacgactggtctccccagctcttccctcctgtttttccacccaattctaagccctgtggtgatccagaccctaccctgacgtgggagtcagaaaggagtatcttccaagctccttgtactcaaagggataaaagaaagctactcagttgttattcagatatattaaccagccatatggaggcaaaaaagggagaaatttaaatatttgttttttaacattttaatgatgaaatatatgcacttggacaaaaatgatcacccagtaaagttgggcgtacattgtggcatgcccatcagggggactttgttgtattggaggagggcaatgtatctggctttgttagtagacgtagcgcattaaagcgtaactattgtgataagtttaggggttaggaatatcatttgagtttggtagatgcttttctggaaaacaatgaggctgggaatgtttctggctttatgttgtattcataaaaataaaatgtactggcttggaaa

SEQ ID NO: 114467 - DNA, 551 bp, Homo sapiens
  Payload ID: 2376
  Gene Symbol: CNDP1
  Gene Name: carnosine dipeptidase 1 (metallopeptidase M20 family)
  ENST ID: ENST00000584316
  CDS Start-End: 1-115
tgctgaccggggcgatgggtggctcacggacccctatgtgctgacggagggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggcccaggtgttttcagccacacctttgacaaggtgaacactaaagcagggcggactccagctgcgtgatcctggtgaccaactcctttctctgacagtcacttcttggatggagttgctgccaatgg

SEQ ID NO: 114468 - DNA, 1012 bp, Homo sapiens
  Payload ID: 2377
  Gene Symbol: CARNMT1
  Gene Name: carnosine N-methyltransferase 1
  ENST ID: ENST00000376830
  CDS Start-End: 183-644
ggagccctgaagacctggcggagcccagcgcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgtatgtgaaagtttgttctatttctgtttattttagggtcaacctctgtattttgaggtcttttattttctggatttcatttttataatctggcacaggctatttgctctactcagaaagttttaacttaaatgttcagtcatttgattaggcttaatagccagagactggatctgttcacttgttttccttttttaagtactaatataactgttgagattttgatgcattttgacataatgttctgttttggaatacagggttagtgacttaaatttttaaaagcaactttactagctagaaattaatttcccttgcttaactcatattttttcagtgtcttgtatctattgctgttcatcttttattgtaagaaattgttttcacttataaatctcaaggga

SEQ ID NO: 114469 - DNA, 4130 bp, Homo sapiens
  Payload ID: 2377
  Gene Symbol: CARNMT1
  Gene Name: carnosine N-methyltransferase 1
  Uniprot ID: Q8N4J0
  ENST ID: ENST00000376834
  CDS Start-End: 154-1383
gcggatggaggcctgagggtggcgggggcggagcgcgccgcgagctgggggcatgtccgcggcgggcgccgtctagaggaaggccaagcagccgccaccacgctgtcggtcgcggagagacgcaagcgagccaggccgagggccgcggcggcgatgcagcgacggcgtcgccctccgccgcccacctcccggctgcccgagggctgcgggggaggaggcggtggcagcgaggaggtggaagtgcagttttccgccgggcgttggggctcggccgcggcggtttcggcggcagcggcggcggccacgcgcagcaccgaggaggaggaggagaggcttgagcgtgagcacttctggaagatcattaatgccttccgctactacggcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagatttattcagaatgcaatacctgggactgtattgctacctgtttcttcatagacacagctcacaatgtaattgattatattgatacaatatggaaaatactcaagccaggtggaatttggataaatctaggtcctctgctgtaccactttgaaaatctggcaaatgaactttccatagaattgagctatgaggatataaaaaacgttgttctgcagtatggattcaaggtagaggtggaaaaagaatctgtattgtcaacatatactgtgaatgatctctctatgatgaaatactactatgaatgtgtcttgtttgtggtccgtaagccacaataatggtctcaagtgataccacctggaaaaaagtttagtaagaacaaatgctgaaatcaacgactcaaaatcaactatcagtgatgacaggacacaacctcaaatcagtggtgccttcttattcctaacgaaatttagaaatagtgtctattttcttaatatgtctattgctttttcagaaatatactatgccatgcagatttgtactacacaagtaaaaatggaggaaatgtcttgaagtatactttttccttgaagcccagaattgtgtttcagtaggaaaaaaacctaatctccagtgtcttcatgatgctgtccattgcaagtctgccgaattaatgactaatagtattgaagtacataataatcttcctttttttgttgttttgtatgcattgcacatgtaacttttagaagagtctaaggatcctcagtcatattcaacatctggagttgggactttgttcactttcaatctaagaaaactatgcgtaaaatatgtctttttttttttttttcttcagagacaggatcccgctctgtctcccaggccggagtgcagtggcacgatcatagctcactgtaacctcaaactcctggactcaagcgatcttcctgccttagccttagcctcctgagtagctaggactgtaggcatgtaccaccgcgcctggcctgtgtctattttatcattcagattaatttaattttgtattttctggctcagatgaacttaaagaagcatcaaacatttcttttttatgaaatgttaaatttaatagcatcacaggccggtaaaatatattcaagtaacagaaatatcaaagtcttttggccacaataaactgaacactttatgaaagcatactcatcatggatcactttgaaatatacgagatctcaacattcaaagtgagaaataaaaagcctttattaaaagtagtgctaggaaacagagaaaataagaataaaatttacccatttgaaatatgtgattttcagactctaaatgaatacagagtttgacagtgtgatgtttacaataatgtcttttctttagaatatctggattatgaaagcaagcacttttttcattaaaaaaattatatactaggaaaaactgtcataatagtattaatgtggggaattttgattatgaaattcagggatatattactgcccgtggtctgtgtcttcaatattgtaagcagcagccatcatgtaatttcagattaataccaattttgttccctgatagatggagcttaaacagtatatgctgctttaaatttctacctctagcagatctttattggagggagttttcctttgtattttttaatgtatgatattctgtttccagtagcttggaaagtagagatgactaatgttttagccttttcttggagaaaaggaagaactcttcttgaatattttcacagatgattgtgattgctttaaatgacctctgtggcaatttaaattagatggatttaatctcagtaatgtgctggtcgcataaatgtcatgttttaataggaaaagttacttgtaaatctttagacctttgttgtcacttaggctggggagtcactaccctatttggcatcttactagttggggggaccttttccgtgtacagtgatgggacttttgtgacctttactctcactatgcaatagagggtttcatgtagttaatctgacatgtcaaaattgggaagactgtaaccttttttttttttttttaagatttctcttttttgtgtccctcaatacttagcagatgttcatttggtggaaattcttattacttacatgaatgagtttgaatttagtggcaaggaagaaaaaaaaaactcaaattattgttttaaaagaagaaaacttgcaaagtacataagtattttttaaaaatcaatcgaacagaaaggaatgcatgctgtttttcaatggcttagacatgctttttattcactgactagtattcacttttttacaacttgtatcaaaacaaatgatctttgtttttgtcacaggcaaaaacaggttgacactggtgggttggctttattaattaattttttttctattaggttttctttaataatgttaaatttctaaattatagcatatgttttagttaattctgaaatcagttacttcatttgttaatttatccctcatatcatgaatattgttttttaaatgttctatacaaatttgcatcacttcttttcttacagcttttgcagttaatatattctaaacttgaaaatgtggtatcaatcaataatagaagtatcactggaggatttatttagctttgtatttcttaattttagtcctagctactaaagtatgtaagccttaaagtttaaaatgtttttcttaaattagctttatacacaaacattttcatttactttatgaaatgggaggagatagtccactgtgcttatgtttttttgtttaatttctatattctgaagcagtgcagatatagggtatgctaatcaagtgagcaaggtggaacatgtacaatataaggagaagctgtaaaaatcacagtataaaattatgaagtttggtaactgtaaaatgtactgtatttatatgtaactctcattctaaaagttgccacaaaagctgaattggaagcttcatgtctgcatgaaatttcctatatttttaatgtgtatgatgaaattaatttttcttgaatattaaagtctgccaattgctatgaaa

SEQ ID NO: 114470 - DNA, 715 bp, Homo sapiens
  Payload ID: 2377
  Gene Symbol: CARNMT1
  Gene Name: carnosine N-methyltransferase 1
  ENST ID: ENST00000451153
  CDS Start-End: 1-715
gttctgaggctgcagttggaatcagacagacatgacctcctacgcagcaccagtatgcatgagcgggtgaaccgaacagaaagacagtttcgatcacttccagctaaccaacagaaactacttcctcagtttcttcttcacttggacaagatccggaaatgcattgatcataatcaagaaatactactgaccattgtgaatgattgcatacatatgtttgaaaataaagaatatggagaagatgggaatggaaagattatgccagcatctacatttgacatggataagttaaaatccacgctgaaacagtttgtgagagactggagtgaaactgggaaagcagaaagggatgcctgttaccagccaatcattaaagaaattttaaaaaattttccaaaagagagatgggatccttctaaagtaaatattctggtacctggtgctggactaggaagactggcctgggaaatagctatgctaggttatgcttgtcaaggaaatgaatggagtttttttatgctcttttcttccaactttgtactcaacagatgttctgaaattaataaatataaactttatccttggatccatcagtttagcaataaccggagatcagctgatcagattcgacccatctttttccctgatgttgacccccacagtcttcctcctggttctaacttttctatgacagcaggagattttcaagagattt

SEQ ID NO: 114471 - DNA, 3942 bp, Homo sapiens
  Payload ID: 2378
  Gene Symbol: CARNS1
  Gene Name: carnosine synthase 1
  Uniprot ID: A5YM72
  ENST ID: ENST00000307823
  CDS Start-End: 453-2936
gctgtgccactgccaccgccgccgccgctgcatcccgcccggtccgagtccgcccgccacgcccgccgagccgctgccgccgccagctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtgaa

SEQ ID NO: 114472 - DNA, 3971 bp, Homo sapiens
  Payload ID: 2378
  Gene Symbol: CARNS1
  Gene Name: carnosine synthase 1
  Uniprot ID: A5YM72
  ENST ID: ENST00000445895
  CDS Start-End: 115-2967
ccactcccaaagtctaggggctggaaggccaggcagggacttggctgccctgactccttcgtctctctgtccctctgtctctgccatcagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggtggcgctggcccagtgcggcctgggcgaggaggcgcaggtggcggctgtgcggcagcgcgtcaaggcggcggccgaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctctccccatcaccatgccccagccccagcctggcccgctgcaatgcctaggtctgttccagagcagcagggcaatttagacaccaaggcatcctggactcaagggcctcttgccctcccgaaggccccagtccagcctacagcttccccagcattctagccttggagaaatgacaatggccacacacacacacacacacacacacacacacctctgacgccagctccccaggtgggagtgggcccaaacccagcccctcctgtccacctctccaggtctcactctcttcctgccatctacaagaggagaggacctggctgggccccaagccttggacaaatcctgggaaaacctgagactagaacccttgtcttcctcttacccaaattctaggatagctctgaagcctgctggaaacttggtggcatccaacctgcctcattcggcctgaccggtagaggcaggtggcctgtggacagaagtaatcctctttctgctcaccccaggcagacacaactgcctatgttcccccgatgagaggaaacaggctgagagaagaaaaatgactgctccaggattataccacagtggagagcgggtcacaggacatgatgcagggtccaggtttctgttttgatcaagtcttacatgcccattcagcttctaggcccccctcacctccctgccctcattcacaagtggccctgagacacgtgaacacctccctcctatgcatcacaaaccttctccaccgagctttggtgctttggcctctggcacacctaactagcattggcagaggagagtctacactctcttcctcattcagggaagatgctttaagaaatcctgcctctgtgcagcagaggagctggaggcagctccccaggcatccctccccaaataaaggcttatgtactggtg

SEQ ID NO: 114473 - DNA, 2968 bp, Homo sapiens
  Payload ID: 2378
  Gene Symbol: CARNS1
  Gene Name: carnosine synthase 1
  Uniprot ID: A5YM72
  ENST ID: ENST00000531040
  CDS Start-End: 111-2885
gctgtgccactgccaccgccgccgccgctgcatcccgcccggtccgagtccgcccgccacgcccgccgagccgctgccgccgccagtctctcagccactccacccacgagatgctctccctggatccatcgggtcccgagtgggattgcccactgggctccaaggacctggaggaagagggcccctggggagggggctctggcctgccgcccacaggctgcttccctggctcctggcgccaggacgtgggcctggactgcaagggatcccccgagggggccgaggcccgggcttggactgtctactactacagcctcctgcagagctgtctgcagcaagctggccttccggagactcaggaccgcggccaggtgccccgcacaggctgtcctggggcggaggtgaccttgtgcgttctgggctcccccagcacctttctgcctgtgctgctggagggtggggtccagagcccgggaaacatgctcctttgcctgtcccctgcttggctgatgaaggtgccagcacccgggcagccgggtgaggcagccctgctagtctccaaggctgtgagcttccaccctgggggcctgacattcctggatgactttgtccccccgcgccgtgccacctactttttggcaggcctgggcctggggcctggccggggccgagaggcagcagaactcgcccgtgacctgacctgccccacaggagcttcggctgagctggcccggctgctggaggaccggctgctgacaaggcagttgctggcccagcagggtggtgtggctgtgccagcaaccctggctttcacctacaagccgccggggctgctgcggggaggggatgccagcctagggctacggctggtggagctgagtggcaaagagggccaggagacgctggtgaaagaggaagtggaggcttttctgcgctccgaggccctgggtgatatcctgcaggtagctgtgaagctcagtggctggcgctggcgggggcggcaggcatggcgtctgcacccgcgggcagagctgggtgcagtggtggacacagtgctggcgctgctggagaagctggaggaggaggagagtgtcctggtggaggctgtgtacccacctgcccagctgccctgctcagatggtccttcacccggccccggcctggccgtgcgaatctgtgctgtggtgtgtcggacacagggtgataggccactgctgagcaaggtggtgtgcggcgtgggccgcggggaccgccctctacggcaccacaactccctgccgaggacgctggaggccgcgctggccgccgtgctggctctggaggccggcctgagtgccgagcagcgcggcgggcgccgggcgcacacggacttcctgggcgtggatttcgcgctgacagcggccggcggcgtgctgaccccagtggccctggagctgaacggcggcctgtgtctggaggcgtgcggcgcgctggaggggctgtgggccgcgccgcggctggggccggcggccgacgaggcggtggcggcgccgctggtggagaccatgcttcggcggtcggcgcgctgcctcatggagggaaaacagctgctggtggtcggcgctggcggcgtcagcaagaagttcgtgtgggaggcggcgcgcgactacgggctccagctgcacctcgtggagtcagaccccaaccactttgcatcccagttggtacagaccttcatccactttgacatgacagagcaccggagggatgaggagaacgcacggctgctggcagagttggtgcgggctcgcggcctcaagctagatggctgcttctcctactgggatgactgcctggtgctcacagccctgctctgccaggagctaggtctgccctgcagctccccagctgccatgcgcctggctaagcagaagagcctcacccagctgcacctgttgcaccaccatggcccaccctggcctgcgccctccctccatgctgtgccctgctgcccactggagagtgaggctgatgtggagagggccgtgcaccaggtacccctgccaggtgtcatgaagctggagttcggggcaggtgcagtgggtgtccggctggtagaggatgcgccacagtgccatgagcacttttcccggattacccgagacttgcagggcgaggccgaccacccaggcattgggctgggctggggcaatgccatgctgctgatggagtttgtggagggcaccgagcacgacgtggacctggtgttgtttggtgggcggttgctggctgcctttgtctccgacaatggccctacgaggctgcctggcttcactgagacggcggcctgcatgcccaccgggctggcaccagagcaggaggcacagatggttcaggcagccttccgctgttgcctgggctgcgggttgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctggaggaggccctggtgcctggcgagtatgaggagccctactgcagtgtggcctgtgccggacccagccccaccgaggcccgtctccgcctgctgggcctctgccagggcctgggcatcgatgggcccagctaccctgttgcccacttcctgtctcacttcaaatagcactggggtcagggggcagggaagcagtgctgggtggaggcactgtggtgccctctgctccctggagctcttcctgcttctct

SEQ ID NO: 114474 - DNA, 915 bp, Homo sapiens
  Payload ID: 2379
  Gene Symbol: CARTPT
  Gene Name: CART prepropeptide
  Uniprot ID: Q16568
  ENST ID: ENST00000296777
  CDS Start-End: 132-482
agacggttgacccgggccctcctccacacccccttccttcttcgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctgatcgaagcgctgcaagaagtcttgaagaagctcaagagtaaacgtgttcccatctatgagaagaagtatggccaagtccccatgtgtgacgccggtgagcagtgtgcagtgaggaaaggggcaaggatcgggaagctgtgtgactgtccccgaggaacctcctgcaattccttcctcctgaagtgcttatgaaggggcgtccattctcctccatacatccccatccctctactttccccagaggaccacaccttcctccctggagtttggcttaagcaacagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctttgtgtaaagaagggaagctttgtttgaaaattgtatttttgtatgtggcatggcagaatgaaaattagatctagctaatctcggtagatgtcattacaacctggaaaataaatcaccctaagtgacacaaattgaagcatgtacaaattatacataataaagtgtttttaataattgcc

SEQ ID NO: 114475 - DNA, 1946 bp, Homo sapiens
  Payload ID: 2380
  Gene Symbol: CRTAC1
  Gene Name: cartilage acidic protein 1
  ENST ID: ENST00000309155
  CDS Start-End: 1-1914
atgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaaatcccatcaataaaggaaaaaacaaaacaaaa

SEQ ID NO: 114476 - DNA, 2348 bp, Homo sapiens
  Payload ID: 2380
  Gene Symbol: CRTAC1
  Gene Name: cartilage acidic protein 1
  Uniprot ID: Q9NQ79
  ENST ID: ENST00000370591
  CDS Start-End: 357-2294
ctggctgccggctgctgccaccgcaatcccggctcctaaatcagcgcggggaggcgctccctccccacgcccggctctccgggctctcggggccgcgattggccgcgccggcgccccccaccccgggcccccggctccagctgccgcgccattggctgcgggcctccgccagcctttacataagaccgggcgcgctcgagtggagttgtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaaatcccatcaataaaggaaaaaacaaaacaaaactaacagcctttgtggaaaact

SEQ ID NO: 114477 - DNA, 2890 bp, Homo sapiens
  Payload ID: 2380
  Gene Symbol: CRTAC1
  Gene Name: cartilage acidic protein 1
  Uniprot ID: Q9NQ79
  ENST ID: ENST00000370597
  CDS Start-End: 357-2342
ctggctgccggctgctgccaccgcaatcccggctcctaaatcagcgcggggaggcgctccctccccacgcccggctctccgggctctcggggccgcgattggccgcgccggcgccccccaccccgggcccccggctccagctgccgcgccattggctgcgggcctccgccagcctttacataagaccgggcgcgctcgagtggagttgtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtga

SEQ ID NO: 114478 - DNA, 474 bp, Homo sapiens
  Payload ID: 2380
  Gene Symbol: CRTAC1
  Gene Name: cartilage acidic protein 1
  ENST ID: ENST00000436034
  CDS Start-End: 1-238
ggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggaaagaaccttgctacttggtctctgcaatctccttggaaaatagaatgctcctgtagccagaacactctttggaaatgatgtaacgccacagaatatgctcacgaccagcctcagtagtgaaggcttgttataaaacatagatctattcttcatggggaaaaaaagtcatcccaggatataataaaattacacttaagaatgcagcaacccttttaaaaacatattcaacaaaaaaaaagcccctgccattttctgatatcatggtaatactcctaataaatcacaaaatatg

SEQ ID NO: 114479 - DNA, 2179 bp, Homo sapiens
  Payload ID: 2380
  Gene Symbol: CRTAC1
  Gene Name: cartilage acidic protein 1
  ENST ID: ENST00000413387
  CDS Start-End: 1-1575
tacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtga

SEQ ID NO: 114480 - DNA, 6630 bp, Homo sapiens
  Payload ID: 2381
  Gene Symbol: CRTAP
  Gene Name: cartilage associated protein
  Uniprot ID: O75718
  ENST ID: ENST00000320954
  CDS Start-End: 100-1305
aagcactgggcccgccgcgtcgcaccgtcctctttcctttccttctccctccccttttcccttccttcgtcccttccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagatcattatgtagaagttctggaatgcaaaatacagtgtgaagagaacctcaccccagttataggaggctatccggttgagaaatttgtggctaccatgtatcattacttgcagtttgcctattataagttgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctagaagatgataattgtgaaaacctcctttggcttatttgcttttccagattttagtctcctttctccccatccgggaaagatggtggaagacataggctaaatttctccagcctcacaatggtcttcacttggtctgacttgtaccaattctagcacccactgaaaaacaagttgagtagagagtgtagagtgcagaaatgtggcttttgccccactttgcatctccaaaattacaacggttggccgatcccatttgaggacaatgcttagttataagtctccgagttggaaaaggaagaaagccagagctgtctagtttcattcattctttcagtaaatatttattgagtacctactgtgtgctaggcattgacctgggaactagagatacttcacagaataacagggaaagttccctgtgctcatggagcttacattctacagggagaaagagatagccaatacataggaataaatatatacaaggtatcatgtagtgataattgctgtggagaaaaataaagcaggggagggagtaagaaatcctggagatgaggctgcagttttaaatggggcctcactgggaatgtgacgttgagcagagacgttagggaagtggatcctggacaaggcattccaggcagaggaacaggatgtgcactgccccaaagtgagaacttgctctacgtggtcaggaaagagcagggagaccaagcagagtcgtgggcaggggtagaatggaaggagaggcggctggggaggacaggtggtggagggccttggcttctgctaagtgagatgggaaccactggagggtttgaacagaggagtgccttgattgatttatattttgcaagggtcattctagctgccatattgtgaaaaactttagtggacaagggcagaaggaagagggaagacctgttaggaagctactgcaaggttccaggcttgggcctgggccacagcaacagcagtggtcaaatatctagatttattttgaaaagagccaataggatttgctgagagtttgaatgtggagtgtaagagaaggaagagttaatgatgacattaaggtttttggcctgaatagcaggaaagatggagttaccagttactgaaatagggaaggatgggctgggtaagtatggaatttggtgcaaagcaggctgtctgtggttggaatgggaggttctggctgcaaatcaaagtggagagttctctcaggtcaggtctgcagcagagctcgagacagggatctgaatgcacttggtttattgttgggggtgctctcagaaggaacctgtgaaagcctttatcagtcatttattggctgtgagaagttctctgggagtgtgggtacatttgaaggcaagtgacttcagttgagggcaagtctctggaaaagaggctgtaggcatctggcagctaccatgcatggtagtgtgttgggggtgggggtcctgggcactggctgtgtgaagggatctggcagggcaccacagcgccccctactgaaccatcagcatgtcagtggcatttaaagccatgcagctggaggggccactgagattgtctctgagtattactgagaagcaacagaaaagagccatggatggagcccttgggctctctgggaaatgggaaatcagccaaaggactgagaaggagttaccttaaggtcagagaaaaccaagagagtgtggtgttctggaagctgagctttctttattcaacctcattcccttctccaaataagccacttgtgtagttgggcccctccagggttgaaggcaagaggagaaaggcacagcgtttgggaaacaagacttttcctgcaatagcctgggaaggaataaaaggatagagtgtttgggtttttgtgtaatggtggttaattggggtggaacactcacacgttgtgctttttctgggcttcccttatcccccagaacactctaccaacctcggggaactcgggcacatccttctgtttctccttcagctctatcctgctttcctcatcccttctgacaccacgtcctcactcacctgcacaagaatccctgcatcaggttctcctttgagggtacccacccaggacagtcccctaccacttctgtcttgggctgaagttgcccacgtccacaaaatctgtactcccagcgggggtgtttggcccgaggagtcagtgttattactggtggatgcaccgtgtccacagcagcccccaatcccagcgatgcgtcagatcttacgtggcttcctgctgggggagatggccttcacccacgggatgccgggttctcctttctttcctcaccccaacctttactccaccagagaaacttccttttgaactcagtggggaagagggtgatgagacaggactagaaagtagtgggggacccagcgagtggacgccctgctccgggattcctgagtctgtaaatagtgtgcccagcagctgtgaactccccttatagcctcaggctgcagtgtccttcccagctgtgtgagaaaatgaaagccgacgtccacagggacccaggcagggttgggtgttgtgactcactccacctctgtgccctgcagaggtactgttgggtccttgtcttgtgagcctggggtgagctctctgtacatgttgttgttccacgtatgggttgacttggcatgctggggggtcctcgttcactctctgaagttggcctcctttcactggggattgaaaagcacctccacccctaccctagtgatgtcccctgaggacccgggtgatagtacagtcaatattgtcagtactttgctttgattgaaggctgtagagctgagttaccaaaatttctatttcaaaggaaaccaaaccttaaaaaaaaaaaacaaaaactgggctgggtcttccaaacctaccatgaaaccctggtgtgcaggctgcactcaatgacctcaacccaacacctccctgagtgtgcttcttggaagagcctagaagattcctggatggagaccccattggttcagcctcaagtctggcccgtcttcgaaaaaacaaacacatttgtaagctttgtgggagcttccaggcctgctctaagatgccttgcttgtcctttgacccatcagcatggagctcagtggttgctgtttggttctgcaggctggtggggaggccgcccatcgtggtggggcatctgtccagccccattgccactcagggcatccaaacaggaggcacccgctgggaagggtctaaagatactccttgtggccactgctactgttcacacttgacttgtggagaagcgaagggctgaggggaggtttgtgtacacccatgtatttaaaagtgactgactgactgaaatgagcacataccgacatatgcaacatactaataccttcctgattttcgagactttctaattactacaactaacctgttgtgctcacctctggaattcagaaagagagccactgcgagcactgaccacaagggctgccttaggaaggaaatgtgtgctttcaggagttcttattaggggaattttaagagcacaaaaattttattgaacccaccttagtgacaaacagaaaatgatttgttagattgtcagttggaaggggtttattatgactgctggtgaaataaacagtgaccagtttctgccaacatttatggaaataacgtttctaggttttaaatgtgagccgtaaactgaagctacttcagttaaaaaaaaaaaaatcaatacttaaactgtagggaaaaggtggattggtgccagagaaaacattatttaatagtgtcagaacatggaactgcaacacagtttgtagcaaggcactgagaaaaacccacaactaatccttcatcgcagctgtctgaactcttgatcatctgccatcccccaaacagtgacttctttttttctggtgactccaggcctgaatgacctagtgtggagagtttaaactatgtacaagggaggaaagaaaaaaaggaaaggaaccttaagtaagcctcagccaaaggttttatgcattggacttcctgtgcctgcccccaggggcaagactgatccccatgcctgtgcccatgacatctccctgaaagaggacaccatgacagcccggctttgccttgactgacccactgctaccccagaaataagaatcaagagcagctattgttatccttagagtgttttccgtctagggccggctcgtgaacagccacatatccttgcacctgacactgtccccacacaaatagctggctttcgttgcttgttgaatgaatgagtgagttggctctatatccccttggagctggccggtaagatattagtgcctcattttacaagaagagaataggaaggaattaagcaatttggccaacagatacaagatagattccagagttttatctcccactttagggtggcagccagtaggccaaactccaaagaccgttgctgatgtctttttctgcctcccctctttgggttagtgtggtatgtacaagctcactcttgttgaaaattagaaaatagttgaaaacaaaaggtttttgtttttctttttaaatcacattaaatgttttacattgctta

SEQ ID NO: 114481 - DNA, 1811 bp, Homo sapiens
  Payload ID: 2381
  Gene Symbol: CRTAP
  Gene Name: cartilage associated protein
  ENST ID: ENST00000449224
  CDS Start-End: 25-1101
ccttccttcctttcgccgggcgcgatggagccggggcgccggggggccgcggcgctgctagcgctgctgtgcgtggcctgcgcgctgcgcgccgggcgcgcccaatacgaacgctacagcttccgcagcttcccacgggacgagctgatgccgctcgagtcggcctaccggcacgcgctggacaagtacagcggcgagcactgggccgagagcgtgggctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagtcccagcccagccgcgaggtgctggcggacttccagcgccgcgagccctacaagttcctgcagttcgcttacttcaaggcaaataatctccccaaagccatcgccgctgctcacacctttctactgaagcatcctgatgacgaaatgatgaagaggaacatggcatattataagagcctgcctggtgccgaggactacattaaagacctggaaaccaagtcatatgaaagcctgttcatccgagcagtgcgggcatacaacggtgagaactggagaacatccatcacagacatggagctggcccttcccgacttcttcaaagccttttacgagtgtctcgcagcctgcgagggttccagggagatcaaggacttcaaggatttctacctttccatagcagtgaacgacctgaagaatgcagccccctgtgcagtcagctatctgctctttgatcagaatgacaaggtcatgcagcagaacctggtgtattaccagtaccacagggacacttggggcctctcggatgagcacttccagcccagacctgaagcagttcagttctttaatgtgaccacactccagaaggagctgtatgactttgctaaggaaaatataatggatgatgatgagggagaagttgtggaatatgtggatgacctcttggaactggaggagaccagctagcccacagcaaccaaagagacttcctcttggcgttcaggaaacacagattctttgtccttttcccaacagcccaggctgttgatacctcagagccttctctttactctccaaagtgaaagggaagcccccgtctctctaactgcatgtcatcaggggtgagcctgcctttcctatcttcacacctgccacctcatgttcacacctatctttctcaccttttttttgagatggagtctcgctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggcctcccacagtgctgggattacaggcgtgagccaccatgcccggcctctttctcacctttacacctgtcttcttatcctcacatctgttttcacaccttcatccctgtcttcctcatgttcacacttgtcttccccatgttcatagctgcctttcttaccattttggtttgaagggcagtcttctctggcttgtttttttgtttttcccagaaaatcagtattattttttaaataagaaaaacattcctag

SEQ ID NO: 114482 - DNA, 4199 bp, Homo sapiens
  Payload ID: 2382
  Gene Symbol: CILP2
  Gene Name: cartilage intermediate layer protein 2
  Uniprot ID: Q8IUL8
  ENST ID: ENST00000291495
  CDS Start-End: 86-3556
agtcccagcggccgccagacccgccggagttggacccgagcacgccgcggagcccggaccctccctcggacgctctgccccggccatggcgtcgctgctgccactgctctgtctctgtgtcgtcgctgcgcacctggcgggggcccgagacgccacccccaccgaggagccaatggcgactgcactgggcctggaaagacggtccgtgtacaccggccagccctcaccagccctggaggactgggaagaggccagcgagtggacgtcctggttcaacgtggaccaccccggaggcgacggcgacttcgagagcctggctgccatccgcttctactacgggccagcgcgcgtgtgcccgcgaccgctggcgctggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactagaagcctcgtggggcgcgtggggcccgtggggtccctgctcggggagctgtgggccaggccgtcgcttgcgccgccgccactgcccaagccccgctggggatgcgtgtcccgggcgtcctctggaggcgcagaagtgcgtgcggcctcggtgtccagggtgcagccttgacacctgtgaatgcccggaccacatcctcctgggctcggtggtcaccccatctgggcaaccactgctaggagccagggtctccctgcgagaccagcctggcactgtggccaccagcgatgctcacggaaccttccgggtgcctggtgtctgtgctgacagccgcgccaacatcagggcccagatggatggcttctctgcaggggaggcccaggcccaggccaacggatccatctctgtggtcaccatcatccttgataagttggagaagccgtacctggtgaaacaccctgagtcccgagtgcgagaggctggccagaatgtgactttctgctgcaaagcctccgggacccccatgcccaagaaatactcctggttccacaatgggaccctgctggacaggcgagctcatgggtacggggcccacctggagctgcggggactgcgcccagaccaggctggcatctaccactgcaaggcatggaatgaggcgggtgccgtgcgctcgggcactgcccggctcactgtacttgccccaggccagccagcctgcgacccccggccccgagagtacctgatcaagctccctgaggactgtggtcagccaggtagtggccctgcctacctggatgtgggcctctgtcccgacacccgctgccccagcctggcaggctccagcccccgctgcggggacgccagctcccgctgctgctctgtgcgccgtctggagagaagggagattcactgccctggctacgtcctcccagtgaaggtggtggcagagtgtggctgccagaagtgtctgccccctcgggggctggtccggggccgtgttgtggctgctgactccggggagccgctacgcttcgccaggattctgctgggccaggagcccatcggcttcaccgcctaccagggcgactttaccattgaggtgccgccctccacccagcggctggtggtgacttttgtggaccccagcggtgagttcatggacgctgtccgggtcttgccttttgatcctcgaggtgccggcgtgtaccacgaggtcaaggccatgcggaagaaagccccggtcattttacataccagccagagcaacacgatccccctgggcgagctggaagatgaggcgcccctgggcgagctggtcctgccttctggcgctttccgcagagccgacggcaaaccctactcggggcctgtggaggcccgggtgacgttcgtggacccccgagacctcacctcggcggcgtctgcccccagtgacctgcgcttcgtggacagcgacggcgagctggctccactgcgcacctacggcatgttctccgtggacctccgtgcgcccggctccgcggagcagctgcaggtggggccggtggccgtgcgggtggccgccagccagatccacatgccaggccacgtggaggccctcaagctgtggtcgctgaaccccgagaccggcttgtgggaggaggagagcggcttccggcgcgaggggtcctcgggcccccgggtgcgccgggaggagcgcgtcttcctggtgggcaacgtggagatccgggagcggcgcctgttcaatctggacgtgcctgagcgccgccgctgcttcgtgaaggtgcgcgcctacgccaacgacaagttcacccccagcgagcaggtggagggcgtggtggtcacgctggtcaatctggagcccgcccccggcttctccgccaacccccgtgcctggggccgctttgacagcgcggtcaccggccccaatggcgcctgcctccccgccttctgcgacgccgacaggccagacgcctacaccgccctggtcaccgccaccctgggcggcgaggagctggagccggccccttccttgccccgcccactcccggccaccgtgggcgtcacccagccctacctggacaggctggggtaccgtcggacggaccacgacgatcccgccttcaagcgtaacggcttccgcatcaacctcgccaagcccaggccaggtgaccccgccgaggccaatgggcctgtgtacccgtggcgcagcctgcgggaatgccagggggccccggtgactgccagccacttccgcttcgccagggtggaggcggacaagtacgagtacaacgtggtccccttccgagagggcacacctgcctcctggactggcgatctcctggcctggtggcccaacccgcaggagttccgggcctgcttcctcaaggtgaagatccagggtccccaggagtatatggtccgctcccacaacgcagggggcagccacccacgcacccgcggccagctctacggacttcgggatgcccggagtgtgcgagaccccgagcgtccgggcacctcggcagcctgcgtggagttcaagtgcagcgggatgctgttcgaccagcggcaggtggacaggacgctggtgaccattatgccccagggcagctgccggcgcgtggccgtcaacggactccttcgggattacctgacccggcaccccccaccggtgcccgcggaggacccagctgccttctccatgctggcccccctagaccctctgggccacaactatggcgtctacactgtcactgaccagagcccacgcttggccaaggagatcgccattggccgctgctttgatggttcctctgacggcttctccagagagatgaaggctgatgccggcacagccgtcaccttccagtgccgggagccaccggccggacgacccagcctcttccagaggctgctggagtccccggcgacagcacttggtgacatccgcagggagatgagcgaggcggcgcaggcacaggcccgggcctcaggtcccctccgcacccgccggggtagggtccggcagtgacctgggcaggggcctcgctttcccacctccctccagactcctttgaccccaggaagttttgcccctccttcttctccagacagccccctccccaggtgtctgggtcccctttcccgcccctttccagaactcagagtcagacaagaacccagagcatccgatggtagaaacaccaggaagacaattgttgctgtgtggtatggaatggagtttgcggtgactctggggccagcacccaggggacgacgttcaaccctagcctgaagggacccgctcccagctcagaagccgtctctgacttctcgtgcgtattttgaccctgatttcaatcttctacccttgggagttctggcgtttggcacaaagtcccctctgcctgtttggagctcagtgctagaccaggtcccctgccccgagctttgtttttggggttatttattgaaacaaagtgtggggagctggttgtgggtgtgagtgggggtgtggggtccaggctgggcccagtgaaaaggaggaaggggttcccatgcgggggaggctctggggctgaggggaacaattctcacgtgtttggtgcttagagacctgcccggggcgttgggcaggccctccgggggctgaattaaaaatgctttatttccaa

SEQ ID NO: 114483 - DNA, 4234 bp, Homo sapiens
  Payload ID: 2382
  Gene Symbol: CILP2
  Gene Name: cartilage intermediate layer protein 2
  ENST ID: ENST00000586018
  CDS Start-End: 103-3591
atcccgcccccactctcagtcccagcggccgccagacccgccggagttggacccgagcacgccgcggagcccggaccctccctcggacgctctgccccggccatggcgtcgctgctgccactgctctgtctctgtgtcgtcgctgcgcacctggcgggggcccgagacgccacccccaccgaggagccaatggcgactgcactgggcctggaaagacggtccgtgtacaccggccagccctcaccagccctggaggactgggaagcgcgtgcggtgcccgcagaggccagcgagtggacgtcctggttcaacgtggaccaccccggaggcgacggcgacttcgagagcctggctgccatccgcttctactacgggccagcgcgcgtgtgcccgcgaccgctggcgctggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactagaagcctcgtggggcgcgtggggcccgtggggtccctgctcggggagctgtgggccaggccgtcgcttgcgccgccgccactgcccaagccccgctggggatgcgtgtcccgggcgtcctctggaggcgcagaagtgcgtgcggcctcggtgtccagggtgcagccttgacacctgtgaatgcccggaccacatcctcctgggctcggtggtcaccccatctgggcaaccactgctaggagccagggtctccctgcgagaccagcctggcactgtggccaccagcgatgctcacggaaccttccgggtgcctggtgtctgtgctgacagccgcgccaacatcagggcccagatggatggcttctctgcaggggaggcccaggcccaggccaacggatccatctctgtggtcaccatcatccttgataagttggagaagccgtacctggtgaaacaccctgagtcccgagtgcgagaggctggccagaatgtgactttctgctgcaaagcctccgggacccccatgcccaagaaatactcctggttccacaatgggaccctgctggacaggcgagctcatgggtacggggcccacctggagctgcggggactgcgcccagaccaggctggcatctaccactgcaaggcatggaatgaggcgggtgccgtgcgctcgggcactgcccggctcactgtacttgccccaggccagccagcctgcgacccccggccccgagagtacctgatcaagctccctgaggactgtggtcagccaggtagtggccctgcctacctggatgtgggcctctgtcccgacacccgctgccccagcctggcaggctccagcccccgctgcggggacgccagctcccgctgctgctctgtgcgccgtctggagagaagggagattcactgccctggctacgtcctcccagtgaaggtggtggcagagtgtggctgccagaagtgtctgccccctcgggggctggtccggggccgtgttgtggctgctgactccggggagccgctacgcttcgccaggattctgctgggccaggagcccatcggcttcaccgcctaccagggcgactttaccattgaggtgccgccctccacccagcggctggtggtgacttttgtggaccccagcggtgagttcatggacgctgtccgggtcttgccttttgatcctcgaggtgccggcgtgtaccacgaggtcaaggccatgcggaagaaagccccggtcattttacataccagccagagcaacacgatccccctgggcgagctggaagatgaggcgcccctgggcgagctggtcctgccttctggcgctttccgcagagccgacggcaaaccctactcggggcctgtggaggcccgggtgacgttcgtggacccccgagacctcacctcggcggcgtctgcccccagtgacctgcgcttcgtggacagcgacggcgagctggctccactgcgcacctacggcatgttctccgtggacctccgtgcgcccggctccgcggagcagctgcaggtggggccggtggccgtgcgggtggccgccagccagatccacatgccaggccacgtggaggccctcaagctgtggtcgctgaaccccgagaccggcttgtgggaggaggagagcggcttccggcgcgaggggtcctcgggcccccgggtgcgccgggaggagcgcgtcttcctggtgggcaacgtggagatccgggagcggcgcctgttcaatctggacgtgcctgagcgccgccgctgcttcgtgaaggtgcgcgcctacgccaacgacaagttcacccccagcgagcaggtggagggcgtggtggtcacgctggtcaatctggagcccgcccccggcttctccgccaacccccgtgcctggggccgctttgacagcgcggtcaccggccccaatggcgcctgcctccccgccttctgcgacgccgacaggccagacgcctacaccgccctggtcaccgccaccctgggcggcgaggagctggagccggccccttccttgccccgcccactcccggccaccgtgggcgtcacccagccctacctggacaggctggggtaccgtcggacggaccacgacgatcccgccttcaagcgtaacggcttccgcatcaacctcgccaagcccaggccaggtgaccccgccgaggccaatgggcctgtgtacccgtggcgcagcctgcgggaatgccagggggccccggtgactgccagccacttccgcttcgccagggtggaggcggacaagtacgagtacaacgtggtccccttccgagagggcacacctgcctcctggactggcgatctcctggcctggtggcccaacccgcaggagttccgggcctgcttcctcaaggtgaagatccagggtccccaggagtatatggtccgctcccacaacgcagggggcagccacccacgcacccgcggccagctctacggacttcgggatgcccggagtgtgcgagaccccgagcgtccgggcacctcggcagcctgcgtggagttcaagtgcagcgggatgctgttcgaccagcggcaggtggacaggacgctggtgaccattatgccccagggcagctgccggcgcgtggccgtcaacggactccttcgggattacctgacccggcaccccccaccggtgcccgcggaggacccagctgccttctccatgctggcccccctagaccctctgggccacaactatggcgtctacactgtcactgaccagagcccacgcttggccaaggagatcgccattggccgctgctttgatggttcctctgacggcttctccagagagatgaaggctgatgccggcacagccgtcaccttccagtgccgggagccaccggccggacgacccagcctcttccagaggctgctggagtccccggcgacagcacttggtgacatccgcagggagatgagcgaggcggcgcaggcacaggcccgggcctcaggtcccctccgcacccgccggggtagggtccggcagtgacctgggcaggggcctcgctttcccacctccctccagactcctttgaccccaggaagttttgcccctccttcttctccagacagccccctccccaggtgtctgggtcccctttcccgcccctttccagaactcagagtcagacaagaacccagagcatccgatggtagaaacaccaggaagacaattgttgctgtgtggtatggaatggagtttgcggtgactctggggccagcacccaggggacgacgttcaaccctagcctgaagggacccgctcccagctcagaagccgtctctgacttctcgtgcgtattttgaccctgatttcaatcttctacccttgggagttctggcgtttggcacaaagtcccctctgcctgtttggagctcagtgctagaccaggtcccctgccccgagctttgtttttggggttatttattgaaacaaagtgtggggagctggttgtgggtgtgagtgggggtgtggggtccaggctgggcccagtgaaaaggaggaaggggttcccatgcgggggaggctctggggctgaggggaacaattctcacgtgtttggtgcttagagacctgcccggggcgttgggcaggccctccgggggctgaattaaaaatgctttatttccaa

SEQ ID NO: 114484 - DNA, 5695 bp, Homo sapiens
  Payload ID: 2383
  Gene Symbol: CILP
  Gene Name: cartilage intermediate layer protein, nucleotide pyrophosphohydrolase
  Uniprot ID: O75339
  ENST ID: ENST00000261883
  CDS Start-End: 168-3722
actggactgctggagaggcgaaggcttggacccccagctgaggagtcctgctcaagacacggtcactggatctgagaaacttcccaggggaccgcattccagagtcagtgactctgtgaagcacccacatctacctcttgccacgttcccacgggcttgggggaaagatggtggggaccaaggcctgggtgttctccttcctggtcctggaagtcacatctgtgttggggagacagacgatgctcacccagtcagtaagaagagtccagcctgggaagaagaaccccagcatctttgccaagcctgccgacaccctggagagccctggtgagtggacaacatggttcaacatcgactacccaggcgggaagggcgactatgagcggctggacgccattcgcttctactatggggaccgtgtatgtgcccgtcccctgcggctagaggctcggaccactgactggacacctgcgggcagcactggccaggtggtccatggtagtccccgtgagggtttctggtgcctcaacagggagcagcggcctggccagaactgctctaattacaccgtacgcttcctctgcccaccaggatccctgcgccgagacacagagcgcatctggagcccatggtctccctggagcaagtgctcagctgcctgtggtcagactggggtccagactcgcacacgcatttgcttggcagagatggtgtcgctgtgcagtgaggccagcgaagagggtcagcactgcatgggccaggactgtacagcctgtgacctgacctgcccaatgggccaggtgaatgctgactgtgatgcctgcatgtgccaggacttcatgcttcatggggctgtctcccttcccggaggtgccccagcctcaggggctgctatctacctcctgaccaagacgccgaagctgctgacccagacagacagtgatgggagattccgaatccctggcttgtgccctgatggcaaaagcatcctgaagatcacaaaggtcaagtttgcccccattgtactcacaatgcccaagactagcctgaaggcagccaccatcaaggcagagtttgtgagggcagagactccatacatggtgatgaaccctgagacaaaagcacggagagctgggcagagcgtgtctctgtgctgtaaggccacagggaagcccaggccagacaagtatttttggtatcataatgacacattgctggatccttccctctacaagcatgagagcaagctggtgctgaggaaactgcagcagcaccaggctggggagtacttttgcaaggcccagagtgatgctggggctgtgaagtccaaggttgcccagctgattgtcatagcatctgatgagactccttgcaacccagttcctgagagctatcttatccggctgccccatgattgctttcagaatgccaccaactccttctactatgacgtgggacgctgccctgttaagacttgtgcagggcagcaggataatgggatcaggtgccgtgatgctgtgcagaactgctgtggcatctccaagacagaggaaagggagatccagtgcagtggctacacgctacccaccaaggtggccaaggagtgcagctgccagcggtgtacggaaactcggagcatcgtgcggggccgtgtcagtgctgctgacaatggggagcccatgcgctttggccatgtgtacatggggaacagccgtgtaagcatgactggctacaagggcactttcaccctccatgtcccccaggacactgagaggctggtgctcacatttgtggacaggctgcagaagtttgtcaacaccaccaaagtgctacctttcaacaagaaggggagtgccgtgttccatgaaatcaagatgcttcgtcggaaaaagcccatcactttggaagccatggagaccaacatcatccccctgggggaagtggttggtgaagaccccatggctgaactggagattccatccaggagtttctacaggcagaatggggagccctacataggaaaagtgaaggccagtgtgaccttcctggatccccggaatatttccacagccacagctgcccagactgacctgaacttcatcaatgacgaaggagacactttcccccttcggacgtatggcatgttctctgtggacttcagagatgaggtcacctcagagccacttaatgctggcaaagtgaaggtccaccttgactcgacccaggtcaagatgccagagcacatatccacagtgaaactctggtcactcaatccagacacagggctgtgggaggaggaaggtgatttcaaatttgaaaatcaaaggaggaacaaaagagaagacagaaccttcctggtgggcaacctggagattcgtgagaggaggctctttaacctggatgttcctgaaagcaggcggtgctttgttaaggtgagggcctaccggagtgagaggttcttgcctagtgagcagatccagggggttgtgatctccgtgattaacctggagcctagaactggcttcttgtccaaccctagggcctggggccgctttgacagtgtcatcacaggccccaacggggcctgtgtgcctgccttctgtgatgaccagtcccctgatgcctactctgcctatgtcttggcaagcctggctggggaggaactgcaagcagtggagtcttctcctaaattcaacccaaatgcaattggcgtccctcagccctatctcaacaagctcaactaccgtcggacggaccatgaggatccacgggttaaaaagacagctttccagattagcatggccaagccaaggcccaactcagctgaggagagcaatgggcccatctatgcctttgagaacctccgggcatgtgaagaggcaccacccagtgcagcccacttccggttctaccagattgagggggatcgatatgactacaacacagtccccttcaacgaagatgaccctatgagctggactgaagactatctggcatggtggccaaagccgatggaattcagggcctgctatatcaaggtgaagattgtggggccactggaagtgaatgtgcgatcccgcaacatggggggcactcatcggcagacagtggggaagctgtatggaatccgagatgtgaggagcactcgggacagggaccagcccaatgtctcagctgcctgtctggagttcaagtgcagtgggatgctctatgatcaggaccgtgtggaccgcaccctggtgaaggtcatcccccagggcagctgccgtcgagccagtgtgaaccccatgctgcatgagtacctggtcaaccacttgccacttgcagtcaacaacgacaccagtgagtacaccatgctggcacccttggacccactgggccacaactatggcatctacactgtcactgaccaggaccctcgcacggccaaggagatcgcgctcggccggtgctttgatggcacatccgatggctcctccagaatcatgaagagcaatgtgggagtagccctcaccttcaactgtgtagagaggcaagtaggccgccagagtgccttccagtacctccaaagcaccccagcccagtcccctgctgcaggcactgtccaaggaagagtgccctcgaggaggcagcagcgagcgagcaggggtggccagcgccagggtggagtggtggcctctctgagatttcctagagttgctcaacagcccctgatcaactaagttttgtggtacttcaccctcttctgccctcatttcatgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggtggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttctgttcttgctagaaacccagtgtagcccagggcagatgtcaataaatgcatactctgtatttcgattctgaggccactgtcctgtcttaactattaaagtgagccagcttctcagaggagtacaggggactctggaaagcagtcacaggtggtgtaagtcctcgccccctaagttacagggcagggcaacataggcacacactccagcagtcaaatttgttctcatggatcacattttccgtttgcagaaaagagcagattcctggagttgtgagcatgttctgggctcctgagcaagactaaaaacacgtcccgatttttttctttccttctttccaatactttggagcttatacaatggcttggcccagggtctgacaagctggccaagtggtcctttggctctcccaacagcctgttgccttctccagctgggctggccggcctcactcagaaatgggcttttacttttttctttatgctcttctaaagatgttcaacttttccagacaccagatctctgttgtgtgttacagaccctgtccctggagcaaaacaattggtccaaacgggcagagttttggttttggaaaaggtatttggtttaaaatagtaaatcagaggcccataggtggtgccagagcgatctcagcggcattacagtcagggtagtggggtgtggggttggataggatgcactcactgcccctatcccaacccctccagaatctgtcaggcaagagtccaaagggtttgggagaagagaggacactgtttacaatcaggacaaaaagctttccctgatgccctggccagcctagtgcagctcctttacccatctctggcctgggctggatttgtactcttggatcaccatctgcccggctcctgggaatttggtttgtaagcaattagaaatttctctagctgagcacatcacaataaccatagaaaaagcaagcatctgcaggagtgaggactagtggtcttgtgattgcaacttgacccacttccagactccacatctgtcccactgctcccaggaagcagctctcactgactgcttggggaggcttgactgcccctgttgtgagtgcacagctatctgcagcaccatcgccccagccacttcaggagccagagtgcctgctgcttcaacctgaccaccagttcacttcaaactcacggggggagggggagggtcgggggggggtgggttgctggggaaggtgggctgactggttccccactctagggcactttccttgctgttctcaattgagggcctgaataaatggactccagcacacagc

SEQ ID NO: 114485 - DNA, 2461 bp, Homo sapiens
  Payload ID: 2384
  Gene Symbol: COMP
  Gene Name: cartilage oligomeric matrix protein
  Uniprot ID: P49747
  ENST ID: ENST00000222271
  CDS Start-End: 46-2319
gtgggcggtagaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 114486 - DNA, 2292 bp, Homo sapiens
  Payload ID: 2384
  Gene Symbol: COMP
  Gene Name: cartilage oligomeric matrix protein
  Uniprot ID: P49747
  ENST ID: ENST00000425807
  CDS Start-End: 37-2151
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggg

SEQ ID NO: 114487 - DNA, 2707 bp, Homo sapiens
  Payload ID: 2384
  Gene Symbol: COMP
  Gene Name: cartilage oligomeric matrix protein
  ENST ID: ENST00000542601
  CDS Start-End: 391-2565
agaaagcgagcagccacccagctccccgccaccgccatggtccccgacaccgcctgcgttcttctgctcaccctggctgccctcggcgcgtccggacagggccagagcccgttgggtaagccgcgttagcacccgcgccgtgcccacggccccacaacggactgtaggacccgtgagaggcccgggatccaggctgtttggggctcacggactgttcgtaggggacgtgccgggcgcagaaagcaggtggcgggaccgagactagaggagcgcagtggggcctcggaggtccgggttcgctgcaacggtgggagttggtggtgggattccccggccccatgacgcctcaccaggtcccctgccgccgcaggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 114488 - DNA, 2619 bp, Homo sapiens
  Payload ID: 2385
  Gene Symbol: CASS4
  Gene Name: Cas scaffolding protein family member 4
  Uniprot ID: Q9NQ75
  ENST ID: ENST00000360314
  CDS Start-End: 226-2586
gaagagtggtgtttttttcttcttcttcttcttttgtggtttcacatagcaaatgagtgacagtctctacttacagacaaagtgagacgtcaggcattgagacatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtgggcagggtgttcccctgatatcagtgactaccttaagaagaggcggttacagcacattaccaaatcctcagaaatcggaatggatttatgacactccagtgtctccaggaaaggccagcgtcagaaacacgcctctcaccagctttgcggaagaatcaaggccccacgctctccccagttccagctccactttctacaatcctccaagtggcagatccaggtccctcactccacaactgaataacaatgtgcccatgcagaaaaaactcagccttccagaaattccttcttatggctttcttgtacccagaggcacatttcctttggatgaagatgtcagctacaaggttccttcaagctttctgattccccgagtggaacagcagaacaccaagcccaatatttatgacatccctaaagcaacgtcgagtgtttctcaggctgggaaggagctggagaaagccaaggaggtgtcagagaattccgcgggccataattcctcatggttctccagacggacaacttccccatctcctgaaccggacagattatcaggttccagttctgacagcagagctagcatcgtttcctcgtgctccaccacatccaccgacgactcctccagctcttcctcggaggagtcagcaaaggagctctccttggacctggatgtggccaaggagacagtgatggctctgcagcacaaggtggtcagctctgtcgctggcctgatgctctttgtcagcaggaagtggagattccgagactatctggaggccaacattgatgcaatccacaggtccactgatcacatagaagaatctgtaagagaatttctggattttgcccgaggagtccatgggactgcctgtaacctcactgacagtaaccttcagaacagaattcgggaccagatgcagaccatctccaactcctaccgcatcctgcttgaaacaaaggaaagcttggataatcgcaattggcctctggaagttcttgtgactgacagtgtccagaacagcccagatgaccttgagaggtttgtcatggtggcacggatgcttccagaagacatcaagaggtttgcctccattgtcattgccaatggaaggctcctttttaagcggaactgtgaaaaggaagagactgtgcagttgaccccaaatgcagaatttaagtgtgaaaaatacatccagcctccccaaagagaaactgaatcacaccaaaagagtaccccttccactaagcaaagggaagatgaacactcttctgaactattaaagaaaaatagggcaaatatctgtggacagaatcctggccctcttatacctcagccttcgagtcaacagactcctgagaggaaaccccgcttatctgaacactgccggctctactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaacgagatcctccgtggcagcagtcacctctgcagcctgctcaaggacgtagcgctggccactaagaatgccgtgctcacgtaccccagccctgccgcgctggggcacctccaggcggaggctgagaagctggagcaacacacgcggcagttcagagggacactgggatgaggactgtctacctcccttcctcctctgctcacc

SEQ ID NO: 114489 - DNA, 2888 bp, Homo sapiens
  Payload ID: 2385
  Gene Symbol: CASS4
  Gene Name: Cas scaffolding protein family member 4
  Uniprot ID: Q9NQ75
  ENST ID: ENST00000434344
  CDS Start-End: 199-1248
attttactcttatcgtgctttccagaaagtttgcctgctgggagagtctttttgatcgtttcccatgtgttgtcagatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcgcccaaggcactcctggccagggcactttatgacaactgccctgactgctctgacgagctggctttcagcagaggggacatcctgaccattctggagcaacacgtgccagaaagcgagggttggtggaagtgtttgctccatgggaggcaaggcctggcccctgccaaccgcctccaaatcctcacggaggtcgctgcagacaggccgtgccccccattcctgagaggcctggaagaagctcctgccagctcagaggagacctatcaggtgcccactctaccccgccctcccactccaggccccgtttatgagcagatgaggagttgggcggaggggccccagccccctactgcccaagtctatgaattccccgaccctcccaccagtgccagaatcatctgtgaaaagactctcagctttccaaaacaggccatcctcacgcttcccagacctgtccgggcctcactgccgactctgccttcccaggtgtatgacgtgcctacccagcaccggggccccgtggtcctgaaggagccagagaagcagcagttatatgacataccagccagccccaagaaggcaggactccatcccccagacagccaagcaagtaatcctggccctcttatacctcagccttcgagtcaacagactcctgagaggaaaccccgcttatctgaacactgccggctctactttggggcgctcttcaaagccatcagcgcatttcacggcagcctcagcagcagccagcccgcggagatcatcactcagagcaagctggtcatcatggtgggacagaagctggtggacacgctgtgcatggagacccaggagagggacgtgcgcaacgagatcctccgtggcagcagtcacctctgcagcctgctcaaggacgtagcgctggccactaagaatgccgtgctcacgtaccccagccctgccgcgctggggcacctccaggcggaggctgagaagctggagcaacacacgcggcagttcagagggacactgggatgaggactgtctacctcccttcctcctctgctcacctctcagcttcacacccacaacttgtgcaactctgccctatgggaaaagccagccggggcatacaccaatgagctgaaacagacctggtgcccaaagctggtagtaccaagtggctaagcaaccccagggcattgacttaccccgcagggggtcaggaaagagagtcaggtatgaggtaaagaccttgtgaagtttagcatatatggagtatgcagtatcagcttgaagtgacttcgcagaaataatattttatattgattaaatgtgtgcatgttttgtttgttttttgagacaaagtctcactctgtcacacaggctggagtgcagtggcgcgatctcagctcactgcaacctccgccttctgggttgaagcaattctcccgcctcagcctccagagtagctggtactacaggtgtgcgccaccatgcccagctaatttttgtatttttttttaatgaaaggtctcacatatttattactgaacccagccaaccaatgcattcataacagattcagaaagaaaaaatatattcccaataaaacatgtacaattctccagagagcggtgacattttcagcttgatgtggtaacatgactgtgaccttcagacagcataaatatgtgtgccctctcatgtgcaattccttatagggctagcttggttcttcttcaatgtctccttttggagttgtacctgattttattaccagttttcatctgaatccactggggagtggggcgattttgttttaatttctcggtcaggaatcacttaatcctggaagtcttatgagaagacatggcaagaagcagagtcaagcacacaccacaatggcagagaaaggaagagctaatttttgtatttttagtagagtcggggtttcaccatattagccaggctggtctggaactcctgacctcaggccatcccccgcctcggcctcccaaagtgctgggattacaggcctgagccaccattcctggcatgtacgtgttttaaattcactcatttaacacttatgtattggatgcctactacatgccaagttctaggtgctggagacatagcagtgtttcagagggcttgccctcttggaacttatgatctagtaggggagtcaggcagtaaagcggtgaagaaatacatacacagtatagcaggtgccaggaaaaacgtaagtaggggaagtgcaagagaacttatcttcaaatggttaatttttattgcatccattagataatagagtaagttttttgttgttttgaattgaattagttctgtgagattggtacaaattatgtatgtgtcttgcacccataaatatatatttttgctatgttactttaacctaaagatagatgttatatttacaacataacatgatctgttgggttctctattaatttatttcatacattatagattctgggttgataaattctgctcaatttgaaaaattttatattttgtctcaaatctgttacaatttatattggttggtgcaaaagtaattgcggtttttgccgtagacagtaatggcaaaaaccacaattgcttttgcaccaccctaataatattaaatataatcatgactttaaacatca

SEQ ID NO: 114490 - DNA, 3942 bp, Homo sapiens
  Payload ID: 2386
  Gene Symbol: CASD1
  Gene Name: CAS1 domain containing 1
  Uniprot ID: Q96PB1
  ENST ID: ENST00000297273
  CDS Start-End: 288-2681
aggaaggggaggagacaggcgtccagggcgcctggggaaccggcacggcggagcagcggcggcggggctggggggaggccgccgagtcggccgcggccgaggaggggcaggcggaggtcgggggcgccgcggccgcggggtcaggttccccggcgggaggcgcaggtggcggcctggggagctggcggccgctcctcgcctggctgcagcggcggcagccccagtgctgcccctgtgcggcgcccctttcccgctccgccgcgcactgttgtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaactactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagagactaaagtattaaatagagaacaaacagacgaatggaaaggctggatgcaacttgtgattttgatttatcacatttctggagcaagtacatttttgcctgtatacatgcacattcgagttctggttgctgcatatttatttcagacagggtatgggcatttctcatacttttggataaaaggagattttggaatctatagagtatgtcaggttttatttcgtctcaatttcctggtagtggtgttatgtatagtaatggatcgaccttatcaattctattactttgtccccttggtcactgtatggttcatggtcatatatgttactttagcactatggccacaaataatccaaaaaaaagcaaacggaaattgtttctggcattttggcttactgttgaaactaggctttttgctgttattcatatgttttttggcatattctcagggtgcatttgagaagatcttttctctttggccattgtccaagtgttttgaactgaaagggaatgtatatgaatggtggttcagatggaggttagaccgttatgtagttttccacggaatgctgtttgcttttatttatctggctttgcagaagcgtcaaatactttctgaaggaaagggtgaacctcttttttcaaacaaaatttcaaattttctgttgtttatttcagtagtttctttcttgacctattccatctgggctagcagttgtaaaaacaaagcagagtgcaatgaactccatccgtctgtttctgtggtacagattttagccttcatcctaataagaaacatccctggatatgcccgttcagtttacagttcattttttgcttggtttggaaaaatttcattagagctatttatttgccagtatcacatatggctggcagcggacacaaggggtatcttggtactgatacctggaaaccctatgctcaacatcattgtcagcactttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaaacctaaactcttcaggctacctttgtgtgtctctagaagagaaaagcatctatctggagatataaatgtgtatgtaaatataaacgtttgtggcaagaggacagttctgtgacatctgttgaacatatgtggttgtatatattggaaatgtacatatccaatatgaaatactaaaacaaacaaacaaacaaaaaaccagaatgcattgtataggattgcatgtgaagtcttttctactgaatctatatttccatttgtaagtgattttaagttaacatatgaaggcagggaaatgattacctttccagtaaaaagtatagataatttaattaacttagtgacaccaccaagtgttttgatataactaaatttgtggtaataagactgtctgcacctgtattcattgtggaacttcctctttcattggaaactttcttactcaagaatgacggcagtattgttttcttatatgtgcaatgaagtggaatgataaacagtatgcctttaatttatatgtgttcttgttctgatgttgtttcctgaaatgatttttcttcctaactgtggttttcgggtatgcaagcctaaatctttgtacactttgtctcacagaatagttctgaggctccatgacagggttttgtcattgttgatgttattgttgcttcgttttataaaaaagccaaaattttttttccaatccaaacgttcacctgtttcctttcctcaagctataccagtgtaataccagttaccctgtggatccatttaatatgttatccccactaattaattttcgtatattatttccaatatttggaaagctctttatagccatttggtatttcctattacccacctcctattttaaatatttatcagtctaaacttgtgcagtgtagtaaacatgcaagttgttacgattgagctgtattaccataagtagaattttaagtaaactggtgaatttgggcaataaatgtttttgctttttgtttgatttttttttacaagctaactgttagaggtatacatttatttatctgttgtacagatttgattatgattttaatgtttgaaagattgcacttgtttgcttttactatatgtggggtaaaatatattttctgttcacagtatatgaaaatatggagtaatttaaacagtaaataaacattctgtggatgcttatttttgtattggcaaagtatcaattaaactatatgtgttctttttcaaaaa

SEQ ID NO: 114491 - DNA, 641 bp, Homo sapiens
  Payload ID: 2386
  Gene Symbol: CASD1
  Gene Name: CAS1 domain containing 1
  ENST ID: ENST00000443644
  CDS Start-End: 18-155
gtcatggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccacttttagaaaaattggcaaagactagtgatgtttattgggtcttacaagatcctgtttatgaagatctattaagtgaaaataggaagatgatcactaatgagaagatagatgcttacaatgaagctgcagtcagtattttgaatagtagcaccagaaattctaaatcaaatgttaagatgttcagtgtttccaaattaattgctcaagaaaccatcatggaatctttggatggcttacatcttcctgaatcgagcagagaaac

SEQ ID NO: 114492 - DNA, 532 bp, Homo sapiens
  Payload ID: 2386
  Gene Symbol: CASD1
  Gene Name: CAS1 domain containing 1
  ENST ID: ENST00000447923
  CDS Start-End: 156-532
aactttggtgtactttcgcccaccagaactgggcaaactgaggacattaaaaaaacggtttaagagaaactggccagagcggcaatgattcgtgtgaataccttctctcaagtggcagatttcttggagagaaagtttggcaacctcacagttgtatgatgcataaatacaaaatcagtgaagcaaagaactgccttgtagataaacatattgcatttattggagattccagaattcgtcaattgttttattcttttgtaaaaataattaatccccaattcaaagaagaaggaaataagcatgaaaacattccttttgaagacaagactgcatcagttaaagtggattttctgtggcatcctgaagttaatggttctatgaaacagtgtatcaaagtgtggactgaggattccattgcaaagccacatgtgattgtagcaggagctgccacatggtccatcaagattcacaatggtagcagtgaagcgctttctcaatataaaatgaacatcacctccatagcaccactttt

SEQ ID NO: 114493 - DNA, 352 bp, Homo sapiens
  Payload ID: 2386
  Gene Symbol: CASD1
  Gene Name: CAS1 domain containing 1
  ENST ID: ENST00000417387
  CDS Start-End: 15-326
atggaggaaccaagatggcggctctggcctacaacctgggcaagcgggagatcaaccactacttcagcgtgaggagcgccaaggtgctggcgctggtggccgtgctgctgctcgcagcgtgccacctcgcctcccgccgctaccgaggcaatgattcgtgtgaataccttctctcaagtggcagatttcttggagagaaagtttggcaacctcacagttgtatgatgcataaatacaaaatcagcatgaaaacattccttttgaagacaagactgcatcagttaaagtggattttctgtggcatcctgaagttaatggttctatgaaacagtgtatcaaagtgtggactgag

SEQ ID NO: 114494 - DNA, 985 bp, Homo sapiens
  Payload ID: 2387
  Gene Symbol: CSN1S1
  Gene Name: casein alpha s1
  Uniprot ID: P47710
  ENST ID: ENST00000246891
  CDS Start-End: 50-607
tcaacacaacttgcttctctccagacttgggcttaaggctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaaggatactaggaatgagtctactcagaactgtgttgtggcagagcctgagaagatggaatccagcatcagttcatcgagtgaggaaatgtctctcagtaagtgtgcggaacagttttgtagactgaacgaatacaaccaacttcagctgcaagctgcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaattacactttaaggcaaaa

SEQ ID NO: 114495 - DNA, 596 bp, Homo sapiens
  Payload ID: 2387
  Gene Symbol: CSN1S1
  Gene Name: casein alpha s1
  ENST ID: ENST00000510936
  CDS Start-End: 1-231
aagatggaatccagcatcagttcatcgagtgaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaattaca

SEQ ID NO: 114496 - DNA, 597 bp, Homo sapiens
  Payload ID: 2387
  Gene Symbol: CSN1S1
  Gene Name: casein alpha s1
  Uniprot ID: P47710
  ENST ID: ENST00000507763
  CDS Start-End: 12-542
ctctgataaccatgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggagaaacattctgagagaaaaacagactgatgaaatcaaggatactaggaatgagtctactcagaactgtgttgtggcagagcctgagaagatggaatccagcatcagttcatcgagtgaggaacagttttgtagactgaacgaatacaaccaacttcagctgcaagctgcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatc

SEQ ID NO: 114497 - DNA, 871 bp, Homo sapiens
  Payload ID: 2387
  Gene Symbol: CSN1S1
  Gene Name: casein alpha s1
  ENST ID: ENST00000505782
  CDS Start-End: 1-510
atgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaagaactgtgttgtggcagagcctgagaagatggaatccagcatcagttcatcgagtgaggaacagttttgtagactgaacgaatacaaccaacttcagctgcaagctgcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaat

SEQ ID NO: 114498 - DNA, 895 bp, Homo sapiens
  Payload ID: 2387
  Gene Symbol: CSN1S1
  Gene Name: casein alpha s1
  ENST ID: ENST00000507772
  CDS Start-End: 1-534
atgaggcttctcattctcacctgtcttgtggctgttgctcttgccaggcctaaacttcctcttagatacccagaacgccttcagaatccatcagagagcagtgagcctataccattagaatcaagagaggaatacatgaatggtatgaacaggcagagaaacattctgagagaaaaacagactgatgaaatcaaggatactaggaatgagtctactcagaactgtgttgtggcagagcctgagaagatggaatccagcatcagttcatcgagtgaggaacagttttgtagactgaacgaatacaaccaacttcagctgcaagctgcccatgcccaggagcaaattcgcagaatgaatgaaaacagccatgtccaagtgcctttccagcagctcaaccaacttgctgcctacccctatgctgtttggtactatccacaaatcatgcagtatgttcctttcccaccgttttccgacatctccaatcccactgctcatgaaaattatgaaaaaaataacgtcatgctacagtggtgatatgattgaaaatttcattctctgaatttctcctctcaaggaaaaccatcttatctgaagactggactgttgttttagaatagtaaaatcccatattgaaggaaattgttctttttgagttatctacttaatagcatatcattctttttcttaagctaaattttcctagagagtttattgtctaaatttcagttgtgtcttgccatatggagggcacctaatcagagggtattaaagtgtttactaagttttctagtggacattttgtttaaaaagtctttgaattgccagttctgtaagtgccatcaattaaaatagttttgtgcagtgacagagattttcttttttcttttcaataaat

SEQ ID NO: 114499 - DNA, 165 bp, Homo sapiens
  Payload ID: 2387
  Gene Symbol: CSN1S1
  Gene Name: casein alpha s1
  ENST ID: ENST00000633258
  CDS Start-End: 1-165
cagagaaacattctgagagaaaaacagactgatgaaatcaagaactgtgttgtggcagagcctgagaagatggaatccagcatcagttcatcgagtgaggaaatgtctctcagtaagtgtgcggaacagttttgtagactgaacgaatacaaccaacttcagctg

SEQ ID NO: 114500 - DNA, 1066 bp, Homo sapiens
  Payload ID: 2388
  Gene Symbol: CSN2
  Gene Name: casein beta
  Uniprot ID: P05814
  ENST ID: ENST00000353151
  CDS Start-End: 13-693
gacttagtagccatgaaggtcctcatcctcgcctgcctggtggctcttgctcttgcaagggagaccatagaaagcctttcaagcagtgaggaatctattacagaatacaagcagaaagttgagaaggttaaacatgaggaccagcagcaaggagaggatgaacaccaggataaaatctacccctctttccagccacagcctctgatctatccattcgttgaacctatcccctatggttttcttccacaaaacattctgcctcttgctcagcctgctgtggtgctgcctgtccctcagcctgaaataatggaagtccctaaagctaaagacactgtctacactaagggcagagtgatgcctgtccttaaatctccaacgatacccttttttgaccctcaaatcccaaaactcactgatcttgaaaatctgcatcttcctctgcctctgctccagcccttgatgcagcaggtccctcagcctattcctcagactcttgcacttccccctcagcccctgtggtctgttcctcagcccaaagtcctgcctatcccccagcaagtggtgccctaccctcagagagctgtgcctgttcaagcccttctgctcaaccaagaacttctacttaaccccacccaccagatctaccctgtgactcagccacttgccccagttcataaccccattagtgtctaagaagatttcaaagttaattttccctccttatttttgaattgactgagactggaaatatgatgccttttccgtctttgtatcacgttaccccaaattaagtatgtttgaatgagtttatatggaaaaaatgaactttgtccctttatttattttatatattatgtcattcatttaatttgaaatttgactcatgaactatttacattttccaaatcttaattcaactagtaccacagaagttcaatactcatttggaaatgctacaaacatatcaaacatatgtatacaaattgtttctggaattgtgcttatttttatttctttaagaatctatttcctttccagtcatttcaataaattattcttaagcata

SEQ ID NO: 114501 - DNA, 1066 bp, Homo sapiens; identical to SEQ ID NO: 114500
  Payload ID: 2388
  Gene Symbol: CSN2
  Gene Name: casein beta
  ENST ID: ENST00000635174
  CDS Start-End: 13-693

SEQ ID NO: 114502 - DNA, 836 bp, Homo sapiens
  Payload ID: 2389
  Gene Symbol: CSN3
  Gene Name: casein kappa
  Uniprot ID: P07498
  ENST ID: ENST00000304954
  CDS Start-End: 87-635
atttttcttgggtcttctctacagctgacaggccaactcaacctactgccaaccaagacctgactggcacgaggaaaggtgcaataatgaagagttttcttctagttgtcaatgccctggcattaaccctgccttttttggctgtggaggttcaaaaccagaaacaaccagcatgccatgagaatgatgaaagaccattctatcagaaaacagctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggacttgctgaaaccaaattactacttcacactctccttcagccatttgtctgccttcagtcaacagaaaatgtgattttcacagattcagctcttctctccttacattttacattcatgccacattcaatattttgattcttgcacaataaagccaactgattgcaa

SEQ ID NO: 114503 - DNA, 6067 bp, Homo sapiens
  Payload ID: 2390
  Gene Symbol: CSNK1A1
  Gene Name: casein kinase 1, alpha 1
  Uniprot ID: P48729
  ENST ID: ENST00000261798
  CDS Start-End: 434-1411
gggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatccttaatatatgtcatctcttttattcctcataacagtaataagaaacagttaactgtttcagaaaagagtggggctgcccaaggcaaggcatgttggtaattggtaagctttatagagccaagacctcaacctgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaa

SEQ ID NO: 114504 - DNA, 2559 bp, Homo sapiens
  Payload ID: 2390
  Gene Symbol: CSNK1A1
  Gene Name: casein kinase 1, alpha 1
  Uniprot ID: P48729
  ENST ID: ENST00000377843
  CDS Start-End: 589-1602
atgcgcagctgggcggtgacagggtgacgctcggagcgtgggccgcgactctcacggatccggttccgccctctcgctgccgatccttcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttc

SEQ ID NO: 114505 - DNA, 620 bp, Homo sapiens
  Payload ID: 2390
  Gene Symbol: CSNK1A1
  Gene Name: casein kinase 1, alpha 1
  ENST ID: ENST00000515748
  CDS Start-End: 205-474
ggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacgcagccccgagtggattaaacctttgaaaagccaagaataaagctgcaggaggcggtgtggaggttcgaggaaggagatggcatagtgacagtgtttgtgatctctgcagcagatgtgacacgaaattgttgaattacactatgtaaaatccttcgtagttcttttaaaagtgttaattactctttc

SEQ ID NO: 114506 - DNA, 1098 bp, Homo sapiens
  Payload ID: 2390
  Gene Symbol: CSNK1A1
  Gene Name: casein kinase 1, alpha 1
  Uniprot ID: P48729
  ENST ID: ENST00000515768
  CDS Start-End: 1-1098
atggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaa

SEQ ID NO: 114507 - DNA, 1099 bp, Homo sapiens
  Payload ID: 2390
  Gene Symbol: CSNK1A1
  Gene Name: casein kinase 1, alpha 1
  ENST ID: ENST00000503350
  CDS Start-End: 1-503
ggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtagccaagaaccaagtgacgttacagggaaaaaattgaatacaaaattgggtaattcatttctaacagtgttagatcaaggaggtggttttaaaatacataaaaatttggctctgcgttaaaaaaaaaaagacgtccttggaaaatttgactactaactttaaacccaaatgtccttgttcatatatatgtatatgtatttgtatatacatatatgtgtgtatatttatatcatttctcttgggattttgggtcatttttttaacaactgcatcttttttactcattcattaaccccctttccaaaaatttggtgttgggaatataatataatcaatcaatccaaaatcctagacctaacacttgttgatttctaataatgaatttggttagccatattttgactttatttcagactaacaatgttaagattttttattttgcatgttaatgctttagcatttaaaatggaaaattgtgaacatgttgtaatttcaagaggtgagtttggcattacccccaaagtgtctatcttctcagttgcagagcatctcattttctctcttaaatgctcaaataaatgcaaagctcagcaca

SEQ ID NO: 114508 - DNA, 1772 bp, Homo sapiens
  Payload ID: 2390
  Gene Symbol: CSNK1A1
  Gene Name: casein kinase 1, alpha 1
  ENST ID: ENST00000504676
  CDS Start-End: 263-973
cagcttttcacttcttcttgtagtcgcgacttggagttttgctaatgtctccctcctttcctaagtgacattgaatccgtagggatgttgatgccatcatcccctctttcccctgcaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggat

SEQ ID NO: 114509 - DNA, 1856 bp, Homo sapiens
  Payload ID: 2390
  Gene Symbol: CSNK1A1
  Gene Name: casein kinase 1, alpha 1
  ENST ID: ENST00000515435
  CDS Start-End: 263-1057
cagcttttcacttcttcttgtagtcgcgacttggagttttgctaatgtctccctcctttcctaagtgacattgaatccgtagggatgttgatgccatcatcccctctttcccctgcaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggat

SEQ ID NO: 114510 - DNA, 775 bp, Homo sapiens
  Payload ID: 2390
  Gene Symbol: CSNK1A1
  Gene Name: casein kinase 1, alpha 1
  ENST ID: ENST00000523203
  CDS Start-End: 393-629
cgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacgcatgtaaagctcataagccttgcactgaagaacctatactgcagcttcaatctatctgccaccttgactcttccctttatgacagcccatgccccaaaatggtttgcccctgcctggtggtatggtcaggaaaaagactacaatgtactagtc

SEQ ID NO: 114511 - DNA, 835 bp, Homo sapiens
  Payload ID: 2390
  Gene Symbol: CSNK1A1
  Gene Name: casein kinase 1, alpha 1
  ENST ID: ENST00000606719
  CDS Start-End: 166-570
tctcttttaaagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtgga

SEQ ID NO: 114512 - DNA, 1075 bp, Homo sapiens
  Payload ID: 2390
  Gene Symbol: CSNK1A1
  Gene Name: casein kinase 1, alpha 1
  ENST ID: ENST00000606299
  CDS Start-End: 189-479
aagttattccttattgattttggtttggccaaaaagtacagagacaacaggacaaggcaacacataccatacagagaagataaaaacctcactggcactgcccgatatgctagcatcaatgcacatcttggtattgagcagaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtagccaagaaccaagtgacgttacagggaaaaaattgaatacaaaattgggtaattcatttctaacagtgttagatcaaggaggtggttttaaaatacataaaaatttggctctgcgttaaaaaaaaaaagacgtccttggaaaatttgactactaactttaaacccaaatgtccttgttcatatatatgtatatgtatttgtatatacatatatgtgtgtatatttatatcatttctcttgggattttgggtcatttttttaacaactgcatcttttttactcattcattaaccccctttccaaaaatttggtgttgggaatataatataatcaatcaatccaaaatcctagacctaacacttgttgatttctaataatgaatttggttagccatattttgactttatttcagactaacaatgttaagattttttattttgcatgttaatgctttagcatttaaaatggaaaattgtgaacatgttgtaatttcaagaggtgagtttggcattacccccaaagtgtctatcttctcagttgcagagcatctcattttctctcttaaatgctcaaataaatgcaaagctcagcaca

SEQ ID NO: 114513 - DNA, 800 bp, Homo sapiens
  Payload ID: 2390
  Gene Symbol: CSNK1A1
  Gene Name: casein kinase 1, alpha 1
  ENST ID: ENST00000606826
  CDS Start-End: 1-553
tggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggaataaagggattcattcctcattttaactgatgttacagtgaagatgggttcttgaactcttggaagcctggatgagccacctaatctgcaagataaaaaccaaagaccaatgcgtattggggaaaagaa

SEQ ID NO: 114514 - DNA, 3088 bp, Homo sapiens
  Payload ID: 2390
  Gene Symbol: CSNK1A1
  Gene Name: casein kinase 1, alpha 1
  ENST ID: ENST00000412431
  CDS Start-End: 687-1187
taaagctggaaagatctaaataacccaacaggaaatgcggatgaaagtgcaagagttggtttgtggtcatctggagtccatgtctccaagactgctggaccttcaaattctgcaacttgttagatcatctggatgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatctttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaat

SEQ ID NO: 114515 - DNA, 2406 bp, Homo sapiens
  Payload ID: 2391
  Gene Symbol: CSNK1A1L
  Gene Name: casein kinase 1, alpha 1-like
  Uniprot ID: Q8N752
  ENST ID: ENST00000379800
  CDS Start-End: 409-1422
tttgtggttggctgaggtggaggaacaaaatggcggcgccggcggcgtgaccgggccctctggcccacagccgttggtagcggtggcagcagtactgctgccccaactcgctgtgccccctttctcagcccacgacatcgccacgacagcgaggcagcgaccgccaccgagaaagaggtggtggcccagcctggaaccttgagaaaccctcgcaaactgtggcctggcggaaatcctggtgtgctgcagggatcaggctgactccacgccctgtaacaccgggaaacgcctcggtggccatttccagcagccctcatcctcagccttgcgggccggtgggccccggaggcctccatcctcccctagaggggtcagggctgagcccagcctccatctttgcctctcaggatgacaaacaacagcggctccaaagccgaactcgttgtgggagggaaatacaaactggtgcggaagatcgggtctggctcctttggagacgtttatctgggcatcaccaccaccaacggcgaggacgtagcagtgaagctggaatctcagaaggtcaagcacccccagttgctgtatgagagcaaactctacacgattcttcaaggtggggttggcatcccccacatgcactggtatggtcaggaaaaagacaacaatgtgctagtcatggaccttctgggacccagcctcgaagacctctttaatttctgttcaagaaggttcaccatgaaaactgtacttatgttagccgaccagatgatcagcagaattgaatacgtgcatacaaagaattttctacaccgagacattaaaccagataacttcctgatgggtactgggcgtcactgtaataagttgttccttattgattttggtttggccaaaaagtacagagacaacaggaccaggcaacacataccgtacagagaagataaacacctcattggcactgtccgatatgccagcatcaatgcacatcttggtattgagcagagccgccgagatgacatggaatccttaggctacgttttcatgtattttaatagaaccagcctgccgtggcaaggactaagggctatgacaaaaaaacaaaaatatgaaaagattagtgagaagaagatgtccacccctgttgaagttttatgtaaggggtttcctgcagaattcgccatgtacttgaactactgtcgtgggctgcgctttgaggaagtcccagattacatgtatctgaggcagctattccgcattcttttcaggaccctgaaccaccaatatgactacacatttgattggacgatgttaaagcagaaagcagcacagcaggcagcctcttccagtgggcagggtcagcaggcccaaacccagacaggcaagcaaactgaaaaaaacaagaataatgtgaaagataactaagcgtgaatgaggaacagaagaagcagagcagatgattcgagcagcatttgtttctccccacatctagaaattgtagttcatatgtacaccagctagtggctgtgaacaaccatttagttggtgtaaaaaactttatttcaatataaactgactctggggagcgttggtgatgctgtatcccaaagtgtagcctctgtaattgtgaatattaactgaggtagtgaaacgtggtgtctggttttctattgcatttattcaagtagaaaagttaactaaatggttgacacacacgaattggtggagacattgtccatatgccaattttttgttaaaaccttttattttgaactagactgctttgagatatcatttcagaaggacagtattcagccacagctgcaaaggttgtaaatgcttatgattgagcatttttagggtttctccatccctggggtttgcaaattgttcacataaagagcattcttaaaatggttggcttcttgtctgtaagccagctgatctagtagtaaccaaaaattccagttttgagaataggaaagattccgcctgcttacctgtgaagacataagaaaatcttagtaactaccagattatctttagaattccacattaactatatcatgttctcggtattttaaaaacaacaacaaccatatttgtcacagaaatttagttaacatcttacaactgaacatgtatgtacatggcttagataaatgtaatcaccgtaaacacccatatgatctgggattttgttcatattttgaaatgggagcttttatgttttacaagttcactaaaatctgaaaactgtttctataaggaaataatacttttttaaacaacaaccaaaaaatgccttgctgattcactaggaaataaaaatctccccaattttttgatagtcaacttcgagccatttgttacatgatattcccttgcaagtaaattttatttcattat

SEQ ID NO: 114516 - DNA, 1088 bp, Homo sapiens
  Payload ID: 2392
  Gene Symbol: CSNK1D
  Gene Name: casein kinase 1, delta
  ENST ID: ENST00000269361
  CDS Start-End: 1-361
gctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatg

SEQ ID NO: 114517 - DNA, 3712 bp, Homo sapiens
  Payload ID: 2392
  Gene Symbol: CSNK1D
  Gene Name: casein kinase 1, delta
  Uniprot ID: P48730
  ENST ID: ENST00000314028
  CDS Start-End: 351-1598
gccccgccgggttgctaggggaagtgacgtcacagcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctaccttt

SEQ ID NO: 114518 - DNA, 2047 bp, Homo sapiens
  Payload ID: 2392
  Gene Symbol: CSNK1D
  Gene Name: casein kinase 1, delta
  Uniprot ID: P48730
  ENST ID: ENST00000392334
  CDS Start-End: 317-1546
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaa

SEQ ID NO: 114519 - DNA, 1580 bp, Homo sapiens
  Payload ID: 2392
  Gene Symbol: CSNK1D
  Gene Name: casein kinase 1, delta
  ENST ID: ENST00000398519
  CDS Start-End: 48-1331
cccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaggagcagggacatggcatctctccggctgcacgcggcccgccagggcacccgctgccgtccccagcgcccacgacgcacctactgagggccccggcggcctctgaccgggctcccagccacgcaggccactgctggccacgagggcaggtgggtgttaggtgtccaggacaagcccaagcgctgggccgggctggatggaggacagggtgcaaagaccagccctgggcactgaccacaccacgcacactgccagccaggcagaggggcgaaaaagggaaggcaggagggtcctgtttcttaaacacagcagtgaataaagtggcttgttccacct

SEQ ID NO: 114520 - DNA, 1040 bp, Homo sapiens
  Payload ID: 2392
  Gene Symbol: CSNK1D
  Gene Name: casein kinase 1, delta
  ENST ID: ENST00000403276
  CDS Start-End: 51-431
agacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacacc

SEQ ID NO: 114521 - DNA, 401 bp, Homo sapiens
  Payload ID: 2392
  Gene Symbol: CSNK1D
  Gene Name: casein kinase 1, delta
  ENST ID: ENST00000584672
  CDS Start-End: 1-193
gagagagcggaaagtgagtatgcggctgcaccgcggggcccccgtcaacatctcctcgtccgacctcacaggccgacaagatacctctcgcatgtccacctcacagaggagcagggacatggcatctctccggctgcacgcggcccgccagggcacccgctgccgtccccagcgcccacgacgcacctactgagggccccggcggcctctgaccgggctcccagccacgcaggccactgctggccacgagggcagatccactctggaatgacacggttcccaccccgccaccttccccctcaaaacactgatcgggcgacgatccgctgggccggcagctggagcccagccgtggccctgcctgagccagtccagtttgtaaaataaatagcaagcgttgc

SEQ ID NO: 114522 - DNA, 563 bp, Homo sapiens
  Payload ID: 2392
  Gene Symbol: CSNK1D
  Gene Name: casein kinase 1, delta
  ENST ID: ENST00000585026
  CDS Start-End: 20-190
gaatcgggccgccgccgccatggagctgagagtcgggaacaggtaccggctgggccggaagatcggcagcggctccttcggagacatctatctcggctggagtgcagtggcgcgatctcggctcactgcaagctccgcctcccagagatggggtttcaccgtgttagccaggatggtctcaatctcctgaccttgtgatccgcccgccttggcctcccaaagtgctgggattacaggcgtgagccaccgcgcccggccgattccagtgtcttatactctgaagggactcgtgagggaagaggagagagctgggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgct

SEQ ID NO: 114523 - DNA, 612 bp, Homo sapiens
  Payload ID: 2392
  Gene Symbol: CSNK1D
  Gene Name: casein kinase 1, delta
  ENST ID: ENST00000580446
  CDS Start-End: 51-612
agacccaggaagcggccgggagggcaggagcgaatcgggccgccgccgccatggagctgagagtcgggaacaggtaccggctgggccggaagatcggcagcggctccttcggagacatctatctcgtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaat

SEQ ID NO: 114524 - DNA, 1081 bp, Homo sapiens
  Payload ID: 2392
  Gene Symbol: CSNK1D
  Gene Name: casein kinase 1, delta
  ENST ID: ENST00000580784
  CDS Start-End: 1-61
tatgactacgtgttcgactggaacatgctcaaatttgttgctgtctcggcttaaaatctgacctccccacccccgtgcatctggatagtgcagcacagatccggctgccggctgctggccacgccaccacacctgcacaggctgttggaggctgcagggtccggaccctgagtgtactcctcgtccgaccaaacgctctcatccccaccccgctttcctccccagctgtcaccatttggggcctgtctttggcctccgatggttcctgtccctctcctctttctgcacgtgttagtgagcatgttcacagagcagcagggggtagctgctgcccatttggaagtttaaggaagttctgagcccacagggagatgccatggcgagtggggttttttcgattgttgggggagctgagaggcctggctctgaccccttgtggggatgatgctgtcatcccatgaggagaaacgtgcagcctgtggggggctttgcaggcagtctcgtcccagtgccctttgggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagc

SEQ ID NO: 114525 - DNA, 611 bp, Homo sapiens
  Payload ID: 2392
  Gene Symbol: CSNK1D
  Gene Name: casein kinase 1, delta
  ENST ID: ENST00000581660
  CDS Start-End: 77-208
agcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcgtagagatggggtttcaccgtgttagccaggatggtctcaatctcctgaccttgtgatccgcccgccttggcctcccaaagtgctgggattacaggcgtgagccaccgcgcccggccgattccagtgtcttatactctgaagggactcgtgagggaagaggagagagctgggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaa

SEQ ID NO: 114526 - DNA, 2642 bp, Homo sapiens
  Payload ID: 2393
  Gene Symbol: CSNK1E
  Gene Name: casein kinase 1, epsilon
  Uniprot ID: P49674
  ENST ID: ENST00000359867
  CDS Start-End: 112-1362
ggttgggatctgaggggtcctctctgtgcccatcacagtttgagcttcagggaaaagaagaagaggtctttgcccttcgtttttccacgggaggagaatcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtga

SEQ ID NO: 114527 - DNA, 2791 bp, Homo sapiens
  Payload ID: 2393
  Gene Symbol: CSNK1E
  Gene Name: casein kinase 1, epsilon
  Uniprot ID: P49674
  ENST ID: ENST00000396832
  CDS Start-End: 262-1512
gcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtg

SEQ ID NO: 114528 - DNA, 2321 bp, Homo sapiens
  Payload ID: 2393
  Gene Symbol: CSNK1E
  Gene Name: casein kinase 1, epsilon
  Uniprot ID: P49674
  ENST ID: ENST00000400206
  CDS Start-End: 467-1717
ctttcaaacccggccggcccgagtggagtcagctcagtcccggcagccgccgcgcgaggaaatggccgaggggccggagccacagtccacagacaaacgaatttaaaggagcaaccgaggaggcacctgcgaaagaaagcccacacacaggtgaatttaaaggagcagccctggtgtcacctatcagtaaaagactatttggagttttcctcgtcttactggatgtcactctcgtccttgccgacctaattttcactgacagcaaactttatattcctttggagtatcgttctatttctctagctattgccttattttttctcatggatgttcttcttcgagtatttgtagaagggtgttggagcgggccggagagaagtagagtgggctgcgaggagaaggaaacaggcctttcggaggctcctcatccctcggaggtcatcccttactccagcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccc

SEQ ID NO: 114529 - DNA, 1580 bp, Homo sapiens
  Payload ID: 2393
  Gene Symbol: CSNK1E
  Gene Name: casein kinase 1, epsilon
  Uniprot ID: P49674
  ENST ID: ENST00000403904
  CDS Start-End: 293-1543
cggtgcgagagcgcgcgagccggcggcgggggcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttaggtgag

SEQ ID NO: 114530 - DNA, 2127 bp, Homo sapiens
  Payload ID: 2393
  Gene Symbol: CSNK1E
  Gene Name: casein kinase 1, epsilon
  ENST ID: ENST00000405675
  CDS Start-End: 293-1228
cggtgcgagagcgcgcgagccggcggcgggggcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcacggacactgtccaagatggtagccattggccacatgcgacacatttttaatgaattaaaattaatcaagactggaaatgtcggccaggcctggtggctcatgcctgtaatcccagcactttgggaggccatagagggcggatgacttgaggtcaggagtttaagaccagcctggccaacatggtgaaacccatttctactaaaaacacaaaaattagctgggcatggtggtgtgttcctgtaatcccagctgcttgggaggctgaggcaggagaatcgcttgaacccaggaggcagagattggagtgagctgagatcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctc

SEQ ID NO: 114531 - DNA, 787 bp, Homo sapiens
  Payload ID: 2393
  Gene Symbol: CSNK1E
  Gene Name: casein kinase 1, epsilon
  ENST ID: ENST00000442216
  CDS Start-End: 1-275
gctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttca

SEQ ID NO: 114532 - DNA, 1005 bp, Homo sapiens
  Payload ID: 2393
  Gene Symbol: CSNK1E
  Gene Name: casein kinase 1, epsilon
  ENST ID: ENST00000366216
  CDS Start-End: 1-359
cccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagaccaagggacgagaagacaggagtttggggggccaagtgcagtggctcgcacctgtaatcccagcacttcgggaggcccagacaggtgggtcacttgaggtcaggagttcgagaccagcctggccaacatggtgaaaacccatctctactaaaaacacaaaaattagccgggtgtggtggcacacacctgtaatctcagctactcgggacgctgagacaggagaattgcttgaatctgggaggtggaggttgcagtgagccgagatcgtgccactgcactccagcctgggggacagagcgagactccatctcaaaaaaaaaaaaaagtagccagagacagctgtgtacctcacctgtcttttcccttctcccttctagtgtcttcac

SEQ ID NO: 114533 - DNA, 873 bp, Homo sapiens
  Payload ID: 2393
  Gene Symbol: CSNK1E
  Gene Name: casein kinase 1, epsilon
  ENST ID: ENST00000451964
  CDS Start-End: 1-812
tggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctg

SEQ ID NO: 114534 - DNA, 763 bp, Homo sapiens
  Payload ID: 2393
  Gene Symbol: CSNK1E
  Gene Name: casein kinase 1, epsilon
  ENST ID: ENST00000431632
  CDS Start-End: 1-433
ccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttaggcagtagtccgacacgtcgggggactcaactttacactgggacaatctgtgtgtggtctgttttgtagaaattcatccacacaagagagtggaggcatgaacagggctggccttcctcggatctcaggcccaggaaccaagctgtccatggcgggctgggcagatatttgggggtggggtggggagatgctcaccaggagggcagagaagggagagaatccgtttctgtcacatgaagatggatctcctagcgtgctgggccttgagccaggctctggggcccagagggagatagacc

SEQ ID NO: 114535 - DNA, 1631 bp, Homo sapiens
  Payload ID: 2393
  Gene Symbol: CSNK1E
  Gene Name: casein kinase 1, epsilon
  ENST ID: ENST00000413574
  CDS Start-End: 265-1275
ggggcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctcc

SEQ ID NO: 114536 - DNA, 814 bp, Homo sapiens
  Payload ID: 2393
  Gene Symbol: CSNK1E
  Gene Name: casein kinase 1, epsilon
  ENST ID: ENST00000431611
  CDS Start-End: 1-355
acggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcatgcggcccccttcctgccagccccctgcccttccctgtggacggccccaggatgaactagggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttg

SEQ ID NO: 114537 - DNA, 996 bp, Homo sapiens
  Payload ID: 2393
  Gene Symbol: CSNK1E
  Gene Name: casein kinase 1, epsilon
  ENST ID: ENST00000430335
  CDS Start-End: 322-996
ggggacgaggaggagggggcctgttattttgcaggctcgcgggggaggccccccggccggcctgcctccgcttccccccgctgggccctccgaggccccggccggccaggcggccaccccggctgtgatttggggacgctgagggagggggcttggggtgctgggcgccggatactgttgattcgggcccgcgtagcgtttcatcggacaatcaccggcgccccctgctctcccggccccggcgcccggacctgggggttcgcaaggctgcgcccgctcgttggatgacgggcgtttgggggtcctaagcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtat

SEQ ID NO: 114538 - DNA, 8179 bp, Homo sapiens
  Payload ID: 2394
  Gene Symbol: CSNK1G1
  Gene Name: casein kinase 1, gamma 1
  Uniprot ID: Q9HCP0
  ENST ID: ENST00000303052
  CDS Start-End: 497-1765
gtcagtttaacgctgcctgcccaaagtttgtcctattaggcccgccagggtactctgcgactccgggacgagggcggggccgcgctagtggttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctgaa

SEQ ID NO: 114539 - DNA, 1950 bp, Homo sapiens
  Payload ID: 2394
  Gene Symbol: CSNK1G1
  Gene Name: casein kinase 1, gamma 1
  Uniprot ID: Q9HCP0
  ENST ID: ENST00000606225
  CDS Start-End: 129-1310
aatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagagccttaggactgttacagctgagcattatgatgttaacaactcagccatctggcacaggggaagaggcacctaaacagattcttctggacaaaagtcacatatgagcaagatcagaatagtagcagatgtaaaaagcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcaca

SEQ ID NO: 114540 - DNA, 1654 bp, Homo sapiens
  Payload ID: 2394
  Gene Symbol: CSNK1G1
  Gene Name: casein kinase 1, gamma 1
  ENST ID: ENST00000606793
  CDS Start-End: 293-1561
ttgcattagtgtggtacatgaggacagttgtgaggccagtgcacttttggctcagtgggaatgaatgggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagccaaggtctttaacaagcagagtgttttgtccagcagtgaggccccttttcccacttcccagcacccacataaacaggaataatgtgctggaaatgaaaccaggtggcagaagcagctacacatgcaagagaagcctgattgggtccacattaaccagatgacaggagtgagagccttcacttacatttcggggaccatcagtgagaactgggatggcagtgaacctgaaataaagatcgttgaaataagactgg

SEQ ID NO: 114541 - DNA, 2083 bp, Homo sapiens
  Payload ID: 2394
  Gene Symbol: CSNK1G1
  Gene Name: casein kinase 1, gamma 1
  ENST ID: ENST00000607537
  CDS Start-End: 411-1838
agtggttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaaatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggcta

SEQ ID NO: 114542 - DNA, 1756 bp, Homo sapiens
  Payload ID: 2394
  Gene Symbol: CSNK1G1
  Gene Name: casein kinase 1, gamma 1
  ENST ID: ENST00000561349
  CDS Start-End: 199-1515
gacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaaatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttg

SEQ ID NO: 114543 - DNA, 615 bp, Homo sapiens
  Payload ID: 2394
  Gene Symbol: CSNK1G1
  Gene Name: casein kinase 1, gamma 1
  ENST ID: ENST00000634909
  CDS Start-End: 1-522
gcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaatgtatcatcagagcgccgaggagagtgggaaattcagcccagccggcagaccaatacctcatacctaacgtctcacttggctgcagaccgccatgggggatcagtgcagccaaggtctttaacaagcagagtgttttgtccagcagtgaggccccttttcccacttcccagcacccacataaacaggaataatgtgctggaaatgaaaccaggtggcagaagcagctacacatgcaagagaagcctgattgggtccacattaaccagatgacaggagtgagagccttcacttacatttcggggaccatcagtgagaactgggatggcagtgaacctgaaataaagatcgttgaaataagactgg

SEQ ID NO: 114544 - DNA, 799 bp, Homo sapiens
  Payload ID: 2394
  Gene Symbol: CSNK1G1
  Gene Name: casein kinase 1, gamma 1
  ENST ID: ENST00000635324
  CDS Start-End: 134-478
aaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttc

SEQ ID NO: 114545 - DNA, 790 bp, Homo sapiens
  Payload ID: 2394
  Gene Symbol: CSNK1G1
  Gene Name: casein kinase 1, gamma 1
  ENST ID: ENST00000635514
  CDS Start-End: 376-790
acaccaaagggctttattcggccgggagcatcagcaaacttaggtctcaaaaaaccaagctctccaagtgagcaattcctgtcccttttaagggcttacaactgtaagggggtccacgtaagagggtcatgatcgattgagcaagcagggggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttga

SEQ ID NO: 114546 - DNA, 712 bp, Homo sapiens
  Payload ID: 2394
  Gene Symbol: CSNK1G1
  Gene Name: casein kinase 1, gamma 1
  ENST ID: ENST00000634302
  CDS Start-End: 1-615
caaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaactgcctgaaaatgctcaacctgtggtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttggggg

SEQ ID NO: 114547 - DNA, 600 bp, Homo sapiens
  Payload ID: 2394
  Gene Symbol: CSNK1G1
  Gene Name: casein kinase 1, gamma 1
  ENST ID: ENST00000635414
  CDS Start-End: 1-204
gacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggactgttcccttgcaaattctccaatttgactaggaaaatatgaatcaaagatcagtaaagagtactgtttagttctgaccgaggctcagggtttgctagttgaaggggctaagtttgcgcagagataatctgcctccttgtgacctgcgtgcagtttcctaacatgctgcctgccatccagtaggagcacagacagagattgcacactcctcctggccacaggatggccacagctccacatagagctcagtgcaggagacgtctgcccctcctcatttctgggacctttactctgagaggagctttgaaacaagcaagtgcaaaactgaaaatagattccttagcgtcttctgttctatcacctagtcactgcggctcacctcttctcttaattctgtattccatattaaaagtttttttctttc

SEQ ID NO: 114548 - DNA, 2592 bp, Homo sapiens
  Payload ID: 2394
  Gene Symbol: CSNK1G1
  Gene Name: casein kinase 1, gamma 1
  ENST ID: ENST00000634811
  CDS Start-End: 419-1798
cttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggaggacagttgtgaggccagtgcacttttggctcagtgggaatgaatgggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatg

SEQ ID NO: 114549 - DNA, 5548 bp, Homo sapiens
  Payload ID: 2394
  Gene Symbol: CSNK1G1
  Gene Name: casein kinase 1, gamma 1
  ENST ID: ENST00000635142
  CDS Start-End: 225-1517
gttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaactgcctgaaaatgctcaacctgtggtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaactt

SEQ ID NO: 114550 - DNA, 463 bp, Homo sapiens
  Payload ID: 2394
  Gene Symbol: CSNK1G1
  Gene Name: casein kinase 1, gamma 1
  ENST ID: ENST00000635230
  CDS Start-End: 1-110
tagggtcagttcacgtagattctggtgcatctgcaataactcgagaaagccacacacatagggatcggccatcacaacagcagcctcttcgaaatcagagtactgtttagttctgaccgaggctcagggtttgctagttgaaggggctaagtttgcgcagagataatctgcctccttgtgacctgcgtgcagtttcctaacatgctgcctgccatccagtaggagcacagacagagattgcacactcctcctggccacaggatggccacagctccacatagagctcagtgcaggagacgtctgcccctcctcatttctgggacctttactctgagaggagctttgaaacaagcaagtgcaaaactgaaaatagattccttagcgtcttctgttctatcacctagtcactgcggctcacctcttctcttaattctgtattccatattaaaagtttttttctttc

SEQ ID NO: 114551 - DNA, 2485 bp, Homo sapiens
  Payload ID: 2394
  Gene Symbol: CSNK1G1
  Gene Name: casein kinase 1, gamma 1
  ENST ID: ENST00000634654
  CDS Start-End: 309-1688
ctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcat

SEQ ID NO: 114552 - DNA, 830 bp, Homo sapiens
  Payload ID: 2394
  Gene Symbol: CSNK1G1
  Gene Name: casein kinase 1, gamma 1
  ENST ID: ENST00000635270
  CDS Start-End: 281-830
ctttattcggccgggagcatcagcaaacttaggtctcaaaaaaccaagctctccaagttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatac

SEQ ID NO: 114553 - DNA, 601 bp, Homo sapiens
  Payload ID: 2394
  Gene Symbol: CSNK1G1
  Gene Name: casein kinase 1, gamma 1
  ENST ID: ENST00000634722
  CDS Start-End: 1-477
ttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtacgtacatctttcaagggggctcttaagtcatgggttgaaaaatcttttctgtctcttcctctctgtgtgctgctcgtctcagactggatttctcatgcttgtaaccacagctttcttccttaactgttttaatttttgcatggtaccttaaggctgctactgcccttctttagctgtgatttcggggaagacagtcacatttttctagttcacatgaaaaagacatagtgaaccgaaagaatcatgttatcagggctacagtggatagtagccat

SEQ ID NO: 114554 - DNA, 1654 bp, Homo sapiens
  Payload ID: 2394
  Gene Symbol: CSNK1G1
  Gene Name: casein kinase 1, gamma 1
  ENST ID: ENST00000634847
  CDS Start-End: 297-1565
gccttgcagcactgctggaccaggaggacagttgtgaggccagtgcacttttggctcagtgggaatgaatgggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagccaaggtctttaacaagcagagtgttttgtccagcagtgaggccccttttcccacttcccagcacccacataaacaggaataatgtgctggaaatgaaaccaggtggcagaagcagctacacatgcaagagaagcctgattgggtccacattaaccagatgacaggagtgagagccttcacttacatttcggggaccatcagtgagaactgggatggcagtgaacctgaaataaagatcgttgaaataaga

SEQ ID NO: 114555 - DNA, 814 bp, Homo sapiens
  Payload ID: 2394
  Gene Symbol: CSNK1G1
  Gene Name: casein kinase 1, gamma 1
  ENST ID: ENST00000635529
  CDS Start-End: 370-603
cttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttac

SEQ ID NO: 114556 - DNA, 2918 bp, Homo sapiens
  Payload ID: 2395
  Gene Symbol: CSNK1G2
  Gene Name: casein kinase 1, gamma 2
  Uniprot ID: P78368
  ENST ID: ENST00000255641
  CDS Start-End: 536-1783
tatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaa

SEQ ID NO: 114557 - DNA, 780 bp, Homo sapiens
  Payload ID: 2395
  Gene Symbol: CSNK1G2
  Gene Name: casein kinase 1, gamma 2
  ENST ID: ENST00000589350
  CDS Start-End: 530-780
agagaagggggctcccggggccctccccagggaactggccctgggcccagaccagatggaggaccccgaaaagaacagggcaggtttggttggtggcctccagtctcttgtcctcaacgagggttttggcagctccctctcagtggcctctccgctctgcaccgaaggggatgggtccgacccagcctggcatcatcacagcctcgagtggcgtccagcctgccccgctccaccagtggctgctggagaagaacccgagcctggctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggttggtttcagcgttgctggggcaaggctgagggtaaacatgagcgactccaaggccagggagc

SEQ ID NO: 114558 - DNA, 648 bp, Homo sapiens
  Payload ID: 2395
  Gene Symbol: CSNK1G2
  Gene Name: casein kinase 1, gamma 2
  ENST ID: ENST00000591752
  CDS Start-End: 421-648
ccgttacgctccaccgtgtggcccagtgcgccggggcggtccacaaggccatgtggggctctgcctccccaccccaggacatgcaggagccttcttggtgtttcctggctcccggaggccctggtagctcgtgggtgtgggagctgagcaggaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattg

SEQ ID NO: 114559 - DNA, 896 bp, Homo sapiens
  Payload ID: 2395
  Gene Symbol: CSNK1G2
  Gene Name: casein kinase 1, gamma 2
  ENST ID: ENST00000589385
  CDS Start-End: 1-896
gtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccag

SEQ ID NO: 114560 - DNA, 300 bp, Homo sapiens
  Payload ID: 2395
  Gene Symbol: CSNK1G2
  Gene Name: casein kinase 1, gamma 2
  ENST ID: ENST00000585957
  CDS Start-End: 1-300
gaggccgggcaggcgggcggggacgcagggcgggagcaaggctgaccacagacccccgcaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgac

SEQ ID NO: 114561 - DNA, 704 bp, Homo sapiens
  Payload ID: 2395
  Gene Symbol: CSNK1G2
  Gene Name: casein kinase 1, gamma 2
  ENST ID: ENST00000585959
  CDS Start-End: 1-704
gtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccag

SEQ ID NO: 114562 - DNA, 617 bp, Homo sapiens
  Payload ID: 2395
  Gene Symbol: CSNK1G2
  Gene Name: casein kinase 1, gamma 2
  ENST ID: ENST00000591002
  CDS Start-End: 1-617
gtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaagggccgacacgctcaaggagcggtaccagaagatcggggacaccaaacgcgccacgcccatcgaggtgctctgcgagaacttccca

SEQ ID NO: 114563 - DNA, 964 bp, Homo sapiens
  Payload ID: 2395
  Gene Symbol: CSNK1G2
  Gene Name: casein kinase 1, gamma 2
  ENST ID: ENST00000615564
  CDS Start-End: 1-345
ttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgaccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggg

SEQ ID NO: 114564 - DNA, 4635 bp, Homo sapiens
  Payload ID: 2396
  Gene Symbol: CSNK1G3
  Gene Name: casein kinase 1, gamma 3
  Uniprot ID: Q9Y6M4
  ENST ID: ENST00000345990
  CDS Start-End: 720-1991
actcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctg

SEQ ID NO: 114565 - DNA, 4047 bp, Homo sapiens
  Payload ID: 2396
  Gene Symbol: CSNK1G3
  Gene Name: casein kinase 1, gamma 3
  Uniprot ID: Q9Y6M4
  ENST ID: ENST00000360683
  CDS Start-End: 31-1398
gaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgcacattagtctcttgtattcaactttgctgattctctggaattttcctactctttagcataattttgatgattgaaaaatattttggaaaggatgggtcaggtgctttgcctccatagtcttttgaagtgcctgcatatgaacaacaacaacaacaacaaaaaattctgtaaaaaaggaagcccattccacttttcaagtatgctttgttttaagccataaagacacacatgtagttttgtcacattctactagccaaaattttcaagaagggttaaaacaaagactggctagaaagataattattttgaataaatctcatattcatctttcatttatataattgttacttattcctcccatgcagtctcttcgttgtctttaagtgtgtgcctccaggcatgcttatttatttttattgtctcaaggtaacatttaagatgtatattaaagtaaagctacatttttttacttcattattgcatttacagggatttaattgtactttgtaatttatttttcttattagccaaaagtttaatgcatttttttttgatgaattaggcacccacatgaacaccacaaatcaggacattgtttatcattgttgctatgaatcctatgaatgatcttttttttattttaaagacctacacttaacctacaaaacatttgctgtataatttggtcaacagtttctatctatctgtatactgtcatgatgtcttaaactgcaggagttacatactgagtttatatttttatttgctttgagcaaggtagataaacattttggccattataatgtgaaaccacttcttctttctttacagtatttgaccaaacttgtgtgtctatgatatttgtaaatacatgcgaatatctgtatttcttatcataagcctatttagttttattctcagtagggttttttggattgtacagtgtttatatgatctgaactccttatacataagaaggtgtgtatattaatccaattatggacttaaaatattttaaaagtataaatacccttatttgctgcaaagaccagtgtgtaggcatttgctttttagcaatatttttaagtgctccattttaatgccgaggaataagtcttttggcaacacaaactggtcaataataggtaatgcaggtatgttcaggttaagccaacaatgttttgcatttttatgcttattttctgtcaacactaatgaagtcaacattgcctgaatgtctgaataatgaaacacatccctgtttaaaagtatgtaactgaaaaagaaataaaaaaaaataaaagtagtttttttaaacttgctctttcccatttcctctaaagatgggtaaaataatgtcactccctaatttaagataggaattataaaaatttggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgataaa

SEQ ID NO: 114566 - DNA, 2424 bp, Homo sapiens
  Payload ID: 2396
  Gene Symbol: CSNK1G3
  Gene Name: casein kinase 1, gamma 3
  Uniprot ID: Q9Y6M4
  ENST ID: ENST00000361991
  CDS Start-End: 31-1374
gaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccagtcggcagaccacagggcagcttgggactcccagcaggcaaatccccaccatttgagagctcaccttgcagcagacagacatggtggctcggtacaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgcc

SEQ ID NO: 114567 - DNA, 1356 bp, Homo sapiens
  Payload ID: 2396
  Gene Symbol: CSNK1G3
  Gene Name: casein kinase 1, gamma 3
  Uniprot ID: Q9Y6M4
  ENST ID: ENST00000511130
  CDS Start-End: 362-1297
gtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgatt

SEQ ID NO: 114568 - DNA, 1569 bp, Homo sapiens
  Payload ID: 2396
  Gene Symbol: CSNK1G3
  Gene Name: casein kinase 1, gamma 3
  Uniprot ID: Q9Y6M4
  ENST ID: ENST00000512718
  CDS Start-End: 359-1405
gtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttc

SEQ ID NO: 114569 - DNA, 1979 bp, Homo sapiens
  Payload ID: 2396
  Gene Symbol: CSNK1G3
  Gene Name: casein kinase 1, gamma 3
  Uniprot ID: Q9Y6M4
  ENST ID: ENST00000510842
  CDS Start-End: 248-1522
ctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatattt

SEQ ID NO: 114570 - DNA, 2580 bp, Homo sapiens
  Payload ID: 2396
  Gene Symbol: CSNK1G3
  Gene Name: casein kinase 1, gamma 3
  Uniprot ID: Q9Y6M4
  ENST ID: ENST00000521364
  CDS Start-End: 250-1521
agctctctatcaatatcagctcacatcattgaaaagataattttgaagacatgttttgctgaaaagacactaagaaaaattttacgaatgggatgaacatgctccagttaattgactacctactgcaatttgaatgttaacattacccatctggtacagttacctagtgatgtacctattttcacaataccctgtttcagtgtgcttgtcttgattaaagaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattagggaaaaatttatacacaaatgaatatgtggcaattaagttggagcccatgaaatcaagagcaccacagctacatttggaatacagattctataagcagttaggatctggagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactgatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaagaacaaagtagaagagacgatttagaagctttaggtcatatgttcatgtattttctgagaggcagtcttccttggcaaggcttaaaggctgacacattaaaggagaggtatcagaaaattggagatacaaaacgggctacaccaatagaagtgttatgtgaaaattttccagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaactgccagaaagtgttgaacatgtggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgca

SEQ ID NO: 114571 - DNA, 1115 bp, Homo sapiens
  Payload ID: 2396
  Gene Symbol: CSNK1G3
  Gene Name: casein kinase 1, gamma 3
  ENST ID: ENST00000515322
  CDS Start-End: 1-494
aggctgacacattaaaggagaggtatcagaaaattggagatacaaaacgggctacaccaatagaagtgttatgtgaaaattttccagaagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttgcctactccagtgggtgcagttcagcaagatcctgctctgtcatcaaacagagaagcacatcaacacagagataagatgcaacaatccaaaaaccaggttgtaagttctacaaatggagagttaaacacagatgaccccaccgcaggacgttcaaatgcacccatcacagcccctactgaagtagaagtgatggatgaaaccaagtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcag

SEQ ID NO: 114572 - DNA, 4416 bp, Homo sapiens
  Payload ID: 2397
  Gene Symbol: CSNK2A1
  Gene Name: casein kinase 2, alpha 1 polypeptide
  Uniprot ID: P68400
  ENST ID: ENST00000217244
  CDS Start-End: 377-1552
gggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacagctctatcaaggcttgtcaagcagtgtgctcatcacatggtaaatcatgcagcgtggaacctcataaaatctccaagaaacatcattcacccatactgactagtttcacatctctttgtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaatgtccctgca

SEQ ID NO: 114573 - DNA, 4299 bp, Homo sapiens
  Payload ID: 2397
  Gene Symbol: CSNK2A1
  Gene Name: casein kinase 2, alpha 1 polypeptide
  Uniprot ID: P68400
  ENST ID: ENST00000349736
  CDS Start-End: 260-1435
gggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaatgtccctgca

SEQ ID NO: 114574 - DNA, 1451 bp, Homo sapiens
  Payload ID: 2397
  Gene Symbol: CSNK2A1
  Gene Name: casein kinase 2, alpha 1 polypeptide
  Uniprot ID: P68400
  ENST ID: ENST00000400217
  CDS Start-End: 424-1191
ctcgctctggtccctgcggctggcggccgagccgtgtgtctcctcctccatcgccgccatattgtctgtgtgagcagaggggagagcggccgccgccgctgccgcttccaccacagaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggac

SEQ ID NO: 114575 - DNA, 1499 bp, Homo sapiens
  Payload ID: 2397
  Gene Symbol: CSNK2A1
  Gene Name: casein kinase 2, alpha 1 polypeptide
  ENST ID: ENST00000400227
  CDS Start-End: 135-1292
gccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagagatgaagttttgccgtgttgcccaggctggtcttgaactcctgagctcaacagtctacccgccttggcctcccaaagtgctgagattagaggcatgagccaccacacctggcccactagggattcttattggcctcaatgtgagaagcccttccccaggtacctccagatggaagcttacaggatggtcagtccatttcttagagaagttcctggggggattgagtatttctgagtcagcttcactcttgcatcatctgctttgacagttttcttggctcctgtaatgagaaaaagggaaaaaa

SEQ ID NO: 114576 - DNA, 577 bp, Homo sapiens
  Payload ID: 2397
  Gene Symbol: CSNK2A1
  Gene Name: casein kinase 2, alpha 1 polypeptide
  ENST ID: ENST00000608066
  CDS Start-End: 339-577
atattgtctgtgtgagcagaggggagagcggccgccgccgctgccgcttccaccacagccaggcatggtggcgcatgcctgtaatcccagctactcgggaggctgaggcaggagaatcacatgaacctgggaggcggcagaggttgtggtgagccaagatcacgccattgcactccagcctgagcaacaagagcgaaactccatctcaaaaaaaaaaaaaaaagaatagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcg

SEQ ID NO: 114577 - DNA, 581 bp, Homo sapiens
  Payload ID: 2397
  Gene Symbol: CSNK2A1
  Gene Name: casein kinase 2, alpha 1 polypeptide
  ENST ID: ENST00000609525
  CDS Start-End: 358-581
agaaggaatgtgggcagcctctagtggcaaagaccagtccctggctgacaaccagaaagaaatggggacctcagttgtgcaaccagaaggaacctgaatttggtcaacaacctgattgagcttggaagtgaatttcccagtttccaccaaggaatgcaaccttgagacaccttgatttttggcctcgtgagaccctaagcaaaagacctagctagccaagcccacccaacttctgacctacaataacttttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaa

SEQ ID NO: 114578 - DNA, 552 bp, Homo sapiens
  Payload ID: 2397
  Gene Symbol: CSNK2A1
  Gene Name: casein kinase 2, alpha 1 polypeptide
  ENST ID: ENST00000460062
  CDS Start-End: 472-552
atattgtctgtgtgagcagaggggagagcggccgccgccgctgccgcttccaccacagaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtggctaagagactgatagcactggaaactgaaatgtgttaatccattttgcaaactcaggtccgatgccgatgggcgatgggcgcattgtcgggctgcctagagcctgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatg

SEQ ID NO: 114579 - DNA, 2606 bp, Homo sapiens
  Payload ID: 2397
  Gene Symbol: CSNK2A1
  Gene Name: casein kinase 2, alpha 1 polypeptide
  ENST ID: ENST00000619188
  CDS Start-End: 168-1361
atattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttggatgcctgttccagctgccgctgcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatc

SEQ ID NO: 114580 - DNA, 655 bp, Homo sapiens
  Payload ID: 2397
  Gene Symbol: CSNK2A1
  Gene Name: casein kinase 2, alpha 1 polypeptide
  ENST ID: ENST00000619801
  CDS Start-End: 1-357
gactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagagccccagtttgagggacagcgggatatccaccatgctgctgtgagactcgggcagttgtgactggtttagaagtggatacacagggagaggtcttctggaaaaggtcttctggagagctgagatcagaagacaatcaactggcttcaaatctaaggagagacaggcacaaaatggaagagatgacatgggcactggttacctggtaaacacaagtggacactggtgagggactgggtcatggagactgcagtagtctttacccttttcagcgtttttcaccatgaaccccactgggagcacacagaagattggagaaagttttaataaaatgtctcaagatctggaagaagacaatggc

SEQ ID NO: 114581 - DNA, 1416 bp, Homo sapiens
  Payload ID: 2398
  Gene Symbol: CSNK2A3
  Gene Name: casein kinase 2, alpha 3 polypeptide
  Uniprot ID: Q8NEV1
  ENST ID: ENST00000528848
  CDS Start-End: 239-1414
gactctcagattagagatgggaaggtttttatttggattttagaaaattgctccccactccatcgccgccatattgtctgtgtgagcagaagggagagcggccacagccgctgccgcttccaccacagtgtgaagaaaacaggtctgaaacaaggtcttacccccaagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagattgggttgtatgctggcaagtatgatctttcggaaggagccatttttccatggacgtgacaattatgatcagttggtgaggatagccaagtttctggggacagaagatttatatggctatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggccatggagcacccctatttctacactgttgtgaaggaccaggctcgaatgggttcatctagcatgccagggggcagtacgcccgtcagcagcgccaatgtgatgtcagggatttcttcagtgccaactccttcaccccttggacctctggcaggctcaccagtgattgctgctgccaacccccttgggatgcctgttccagctgccactggcgctcagcagtaacg

SEQ ID NO: 114582 - DNA, 1701 bp, Homo sapiens
  Payload ID: 2399
  Gene Symbol: CSNK2A2
  Gene Name: casein kinase 2, alpha prime polypeptide
  Uniprot ID: P19784
  ENST ID: ENST00000262506
  CDS Start-End: 185-1237
cccgcgcccccagcccgcccgcccccgcgggcccggcctggcgcggccgcccgccgccgcgctcctcctcctcctcctccagcgcccggcggcccgctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcgactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaagaaa

SEQ ID NO: 114583 - DNA, 547 bp, Homo sapiens
  Payload ID: 2399
  Gene Symbol: CSNK2A2
  Gene Name: casein kinase 2, alpha prime polypeptide
  ENST ID: ENST00000565188
  CDS Start-End: 143-547
gcggccgcccgccgccgcgctcctcctcctcctcctccagcgcccggcggcccgctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccgg

SEQ ID NO: 114584 - DNA, 947 bp, Homo sapiens
  Payload ID: 2399
  Gene Symbol: CSNK2A2
  Gene Name: casein kinase 2, alpha prime polypeptide
  ENST ID: ENST00000567730
  CDS Start-End: 1-693
ccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggg

SEQ ID NO: 114585 - DNA, 4978 bp, Homo sapiens
  Payload ID: 2399
  Gene Symbol: CSNK2A2
  Gene Name: casein kinase 2, alpha prime polypeptide
  ENST ID: ENST00000563307
  CDS Start-End: 1-458
agggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtaatgcggcattgatgcttgccaataaaaccaaccaaccaaacacaaaccttgaaggaaaactacagtgtgataaaaagaaattcttatcattccttctaaatgcacagaagagtaaagacctaaaagtctgtcaaaaagcaagaaagaaactccccagtgctagtctccagggagctgtcactgtggcagcatggggatgcacctagttcaggatctgaaggagctctgcctttggaatgcatgggagatagagactcggagttgttgtacatttacctttgtttaacagggcaccactgttgaattaacccattcagtcaacaagctctgaatgtctgacttcctatctattccattgtggtctgggtttcctttggtgaaattcaggctcaagtcttagcgaaatgtcagcagtctatactgacacaccagcctcatttacaaaaaggagatattaaaacagtgacagtattttttttttaagctctttacaaatccacgttttatgtattttttaatgacatgagctctccaggaaatgtacctcatccccgcagttttcctccaagtggattcatttgggagcaaactgcagtcactttcacaagagtcctctttgatgtcaggagggatcacgaaaccttgcaatgccatgaactggtccatggttatcatcaaaagttccatgctaagtgcataacttggagctcactataacctttgttgatttccctaaccataaaatcttgttgctatttttttgttgctttttcttttttttttttttttttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatcagggtaatatgcatttgtaagttctgatatgtgatacatttatgtgatggcaaagataagtctgtcttgcatgcaggtactagagttgtgtgggcagggtcatctgaaactcaagcaactcagaggaatatacaaggggcttggggaagaaaatggtgctcccggagcaagtgttggatccattttgcaaaccttcatgttagcagagaaagctagagtttgtttaaacaaaaatagggctgatttcattttggggactcaggagcaacatggtttgtaggcagtcccctcaccccagctgcagggccatgccacagctgtggggacttcacacacctaggctagaactagaggtgtctaccacatcaccctttaagatttctttattaactatttaataatgccatacatttttataaggttagatgtttgtttgaaacatttgtttacattccatattccaataaaatcttattggtattggtagcagatcctactctaaatgtagattctatttttgtcgtttggtctgtgggaacttaaaatacaaatgaaactcttctcttattatagagttgagtttatagagtaaaaaataaataagatcccaaagccaaggaatgcattcagttaaggttctcataccaatgctgcctgcttgcattgcacattctgtatactaatgtaaacatttgttctacctgaaaatcaaaagcaagatgtgagctctttggctaaacctgtattgatatgtcaggcagcaaaactcagtgtttgagattatcaaaagccttctaatatgcccttataggcaatcctgaagcattggttatcatcagggagatgtgccactgcgtgtctttcctgctccccctccaatctcctttatcaccccaccccactcctcagccctccctttttttttttaagttgcctgtctggaccaggcaagaggtgcctactggagggtcttggtgaagcggtaactccattcctttcccttgggtcccccaaaggtaataaaagtacctggaggagaatagtcaggtgattgacctctgcctgtctctctgacggtgatgtaggtgcagacaccgcctgcctgccttgtcctggggttttgtaactgcagctttgacacaggcattcttcctttgaagcacacagcttgcttttccagcacctagacttttacctctcttcatgccttagacttagaccataactgggcttgaaatgctcaccccttcctgggtctggtcttggcacctaggctattcctttccaaactgaagtgagtccagtttcagaccatctcttttcctgtctccaaaaaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacgcagaccaagctttcctgggccttctcaccaactagagaagcgctgatgtcgttcattgaggcacttaaacaccagtcactcagccaggcctcctcccagacattctgtaacatgtcagcactcacaaggtttaaagcaaatgtgttcccttgcagagaggaaggtgctctcagactgatagattagaggagacagacaaactcgtaatccttggggacttgaagagagtggctaggggaagggctgttaaaagaaaagggaccaataagaaaatccatctaaaggtagctcttgaggaggaaattaacttcttgaggggataaattagagggtaccaagtttatgttctggaatgtaccctggggagggcgctgcccactggattggtcccagtggactgaaaggtggtgctctcgagtcaggcgcttagtcccagagagagctgggtgccgcggggctcgtggtctgtgcctactcagggaaatgacttaggttctcccaggtgctctgttgataaggatggaagcagaactactttgagacacaagcaacaattggaagagtttttttatatgaactgaaatagatctaagagagcctggttaacagtttcctttaataccagttcagattaaatggttactttaggaacctgtgttactgtgtgagcacccacagaaacaagcaaacttatttcctacaaaaaatgaggggataataaccgatcagagtcacagtcgtttcaatataaacccttccgaaagcaaaagcagggaccacatgagcacacaagaagccaaagtttgtcagtgatcttaataaattaagactgagtaacatcctgcctttagaaaaaaataaccccgaggtggagaccagggcaggggaggtggcggagaagcatcgggccagatcaaccgttaataacatgcttctgagctatgtggatgtataaatgaaaacacccccaactaggtattgtagaggctggaaaaagatgtgatgggattatacaggtgatgcatatttttgttttgagactcaacaatgtgctacaaatgtgatacttaaccctgaactgcatgtattggggattgttttttaaaaagaaaaaaaacaactttgaatcaataaattaacagtttttcacttgctggctcttcttgctgtaaatggtgactaagaggttgggacagaaatcttgacaactagtggaaaacttggataatcttcaaggaccatggagccttctgtttccttctgtttgcagaaaagcaacactgcctgggttgtgatcctttacaagtgactacttcagacacaattggccacctctttgtatcactggatgactgatgtatgatttatgtgctgctgcccttagagggaagaaaaatgccatgttaaatcctgttttcttaaataaaaatgttgacaataaccagccttcccaagtgggagacaaaccatt

SEQ ID NO: 114586 - DNA, 908 bp, Homo sapiens
  Payload ID: 2400
  Gene Symbol: CSNK2B
  Gene Name: casein kinase 2, beta polypeptide
  Uniprot ID: P67870
  ENST ID: ENST00000375865
  CDS Start-End: 117-764
ggaggaagcgaccaggtccggcacgaaggagggagaggtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 114587 - DNA, 936 bp, Homo sapiens
  Payload ID: 2400
  Gene Symbol: CSNK2B
  Gene Name: casein kinase 2, beta polypeptide
  Uniprot ID: P67870
  ENST ID: ENST00000375866
  CDS Start-End: 145-792
tgtggattccggtgaaagggacctgacaatcgcccccaacccgtgagaaaaggaggagcccagttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 114588 - DNA, 948 bp, Homo sapiens
  Payload ID: 2400
  Gene Symbol: CSNK2B
  Gene Name: casein kinase 2, beta polypeptide
  Uniprot ID: P67870
  ENST ID: ENST00000375882
  CDS Start-End: 157-804
cttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 114589 - DNA, 1061 bp, Homo sapiens
  Payload ID: 2400
  Gene Symbol: CSNK2B
  Gene Name: casein kinase 2, beta polypeptide
  ENST ID: ENST00000375885
  CDS Start-End: 213-917
ccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 114590 - DNA, 908 bp, Homo sapiens
  Payload ID: 2400
  Gene Symbol: CSNK2B
  Gene Name: casein kinase 2, beta polypeptide
  Uniprot ID: P67870
  ENST ID: ENST00000383427
  CDS Start-End: 117-764
ggaggaagcgaccaggtccggcacgaaggagggagaggtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 114591 - DNA, 2487 bp, Homo sapiens
  Payload ID: 2400
  Gene Symbol: CSNK2B
  Gene Name: casein kinase 2, beta polypeptide
  ENST ID: ENST00000383431
  CDS Start-End: 119-805
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 114592 - DNA, 948 bp, Homo sapiens
  Payload ID: 2400
  Gene Symbol: CSNK2B
  Gene Name: casein kinase 2, beta polypeptide
  Uniprot ID: P67870
  ENST ID: ENST00000383433
  CDS Start-End: 157-804
cttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 114593 - DNA, 936 bp, Homo sapiens
  Payload ID: 2400
  Gene Symbol: CSNK2B
  Gene Name: casein kinase 2, beta polypeptide
  Uniprot ID: P67870
  ENST ID: ENST00000400110
  CDS Start-End: 145-792
tgtggattccggtgaaagggacctgacaatcgcccccaacccgtgagaaaaggaggagcccggttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 114594 - DNA, 1061 bp, Homo sapiens
  Payload ID: 2400
  Gene Symbol: CSNK2B
  Gene Name: casein kinase 2, beta polypeptide
  ENST ID: ENST00000400116
  CDS Start-End: 213-917
ccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatga

SEQ ID NO: 114595 - DNA, 2487 bp, Homo sapiens; identical to SEQ ID NO: 114591
  Payload ID: 2400
  Gene Symbol: CSNK2B
  Gene Name: casein kinase 2, beta polypeptide
  ENST ID: ENST00000437010
  CDS Start-End: 119-805

SEQ ID NO: 114596 - DNA, 948 bp, Homo sapiens; identical to SEQ ID NO: 114588
  Payload ID: 2400
  Gene Symbol: CSNK2B
  Gene Name: casein kinase 2, beta polypeptide
  Uniprot ID: P67870
  ENST ID: ENST00000454382
  CDS Start-End: 157-804

SEQ ID NO: 114597 - DNA, 936 bp, Homo sapiens; identical to SEQ ID NO: 114587
  Payload ID: 2400
  Gene Symbol: CSNK2B
  Gene Name: casein kinase 2, beta polypeptide
  Uniprot ID: P67870
  ENST ID: ENST00000448596
  CDS Start-End: 145-792

SEQ ID NO: 114598 - DNA, 908 bp, Homo sapiens; identical to SEQ ID NO: 114586
  Payload ID: 2400
  Gene Symbol: CSNK2B
  Gene Name: casein kinase 2, beta polypeptide
  Uniprot ID: P67870
  ENST ID: ENST00000454511
  CDS Start-End: 117-764

SEQ ID NO: 114599 - DNA, 908 bp, Homo sapiens
  Payload ID: 2400
  Gene Symbol: CSNK2B
  Gene Name: casein kinase 2, beta polypeptide
  Uniprot ID: P67870
  ENST ID: ENST00000431476
  CDS Start-End: 117-764
ggaggaagcgaccaggtccggcacgaaggagggagaggtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 114600 - DNA, 936 bp, Homo sapiens; identical to SEQ ID NO: 114593
  Payload ID: 2400
  Gene Symbol: CSNK2B
  Gene Name: casein kinase 2, beta polypeptide
  Uniprot ID: P67870
  ENST ID: ENST00000453234
  CDS Start-End: 145-792

SEQ ID NO: 114601 - DNA, 1061 bp, Homo sapiens; identical to SEQ ID NO: 114589
  Payload ID: 2400
  Gene Symbol: CSNK2B
  Gene Name: casein kinase 2, beta polypeptide
  ENST ID: ENST00000428483
  CDS Start-End: 213-917

SEQ ID NO: 114602 - DNA, 1061 bp, Homo sapiens; identical to SEQ ID NO: 114589
  Payload ID: 2400
  Gene Symbol: CSNK2B
  Gene Name: casein kinase 2, beta polypeptide
  ENST ID: ENST00000424502
  CDS Start-End: 213-917

SEQ ID NO: 114603 - DNA, 948 bp, Homo sapiens; identical to SEQ ID NO: 114588
  Payload ID: 2400
  Gene Symbol: CSNK2B
  Gene Name: casein kinase 2, beta polypeptide
  Uniprot ID: P67870
  ENST ID: ENST00000443673
  CDS Start-End: 157-804

SEQ ID NO: 114604 - DNA, 948 bp, Homo sapiens
  Payload ID: 2400
  Gene Symbol: CSNK2B
  Gene Name: casein kinase 2, beta polypeptide
  Uniprot ID: P67870
  ENST ID: ENST00000422567
  CDS Start-End: 157-804
cttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 114605 - DNA, 936 bp, Homo sapiens; identical to SEQ ID NO: 114587
  Payload ID: 2400
  Gene Symbol: CSNK2B
  Gene Name: casein kinase 2, beta polypeptide
  Uniprot ID: P67870
  ENST ID: ENST00000455161
  CDS Start-End: 145-792

SEQ ID NO: 114606 - DNA, 2487 bp, Homo sapiens
  Payload ID: 2400
  Gene Symbol: CSNK2B
  Gene Name: casein kinase 2, beta polypeptide
  ENST ID: ENST00000413083
  CDS Start-End: 119-805
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctggctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 114607 - DNA, 2487 bp, Homo sapiens
  Payload ID: 2400
  Gene Symbol: CSNK2B
  Gene Name: casein kinase 2, beta polypeptide
  ENST ID: ENST00000416194
  CDS Start-End: 119-805
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctggtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaa

SEQ ID NO: 114608 - DNA, 908 bp, Homo sapiens; identical to SEQ ID NO: 114586
  Payload ID: 2400
  Gene Symbol: CSNK2B
  Gene Name: casein kinase 2, beta polypeptide
  Uniprot ID: P67870
  ENST ID: ENST00000429633
  CDS Start-End: 117-764

SEQ ID NO: 114609 - DNA, 936 bp, Homo sapiens
  Payload ID: 2400
  Gene Symbol: CSNK2B
  Gene Name: casein kinase 2, beta polypeptide
  Uniprot ID: P67870
  ENST ID: ENST00000458330
  CDS Start-End: 145-792
tgtggattccggtgaaagggacctgacaatcgcccccaacccgtgagaaaaggaggagcccggttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatga

SEQ ID NO: 114610 - DNA, 1061 bp, Homo sapiens; identical to SEQ ID NO: 114589
  Payload ID: 2400
  Gene Symbol: CSNK2B
  Gene Name: casein kinase 2, beta polypeptide
  ENST ID: ENST00000439572
  CDS Start-End: 213-917

SEQ ID NO: 114611 - DNA, 908 bp, Homo sapiens; identical to SEQ ID NO: 114586
  Payload ID: 2400
  Gene Symbol: CSNK2B
  Gene Name: casein kinase 2, beta polypeptide
  Uniprot ID: P67870
  ENST ID: ENST00000418230
  CDS Start-End: 117-764

SEQ ID NO: 114612 - DNA, 936 bp, Homo sapiens
  Payload ID: 2400
  Gene Symbol: CSNK2B
  Gene Name: casein kinase 2, beta polypeptide
  Uniprot ID: P67870
  ENST ID: ENST00000436169
  CDS Start-End: 145-792
tgtggattccggtgaaagggacctgacaatcgcccccaacccgtgagaaaaggaggagcccagttcttgcttgagaatgataaacttggaaacccttgggaaaggcgtgggggtcatgcagagacttgtattgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 114613 - DNA, 1061 bp, Homo sapiens
  Payload ID: 2400
  Gene Symbol: CSNK2B
  Gene Name: casein kinase 2, beta polypeptide
  ENST ID: ENST00000422261
  CDS Start-End: 213-917
ccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcagctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgtcttttcctttcttttttgccaccctttcaggaaccctgtatggtttttagtttaaattaaaggagtcgttatcgtggtgggaatatgaaataaagtagaagaaaaggccatga

SEQ ID NO: 114614 - DNA, 908 bp, Homo sapiens; identical to SEQ ID NO: 114590
  Payload ID: 2400
  Gene Symbol: CSNK2B
  Gene Name: casein kinase 2, beta polypeptide
  Uniprot ID: P67870
  ENST ID: ENST00000412802
  CDS Start-End: 117-764

SEQ ID NO: 114615 - DNA, 948 bp, Homo sapiens; identical to SEQ ID NO: 114588
  Payload ID: 2400
  Gene Symbol: CSNK2B
  Gene Name: casein kinase 2, beta polypeptide
  Uniprot ID: P67870
  ENST ID: ENST00000452985
  CDS Start-End: 157-804

SEQ ID NO: 114616 - DNA, 948 bp, Homo sapiens; identical to SEQ ID NO: 114592
  Payload ID: 2400
  Gene Symbol: CSNK2B
  Gene Name: casein kinase 2, beta polypeptide
  Uniprot ID: P67870
  ENST ID: ENST00000451917
  CDS Start-End: 157-804

SEQ ID NO: 114617 - DNA, 1061 bp, Homo sapiens; identical to SEQ ID NO: 114594
  Payload ID: 2400
  Gene Symbol: CSNK2B
  Gene Name: casein kinase 2, beta polypeptide
  ENST ID: ENST00000432290
  CDS Start-End: 213-917

SEQ ID NO: 114618 - DNA, 1181 bp, Homo sapiens
  Payload ID: 2400
  Gene Symbol: CSNK2B
  Gene Name: casein kinase 2, beta polypeptide
  ENST ID: ENST00000620798
  CDS Start-End: 13-699
gctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctgaattccacagtgcaaatatctttctgtaacaccctcagcatcctgcactgccctctctgaaaaca

SEQ ID NO: 114619 - DNA, 826 bp, Homo sapiens
  Payload ID: 2400
  Gene Symbol: CSNK2B
  Gene Name: casein kinase 2, beta polypeptide
  ENST ID: ENST00000621623
  CDS Start-End: 341-826
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctga

SEQ ID NO: 114620 - DNA, 1255 bp, Homo sapiens
  Payload ID: 2400
  Gene Symbol: CSNK2B
  Gene Name: casein kinase 2, beta polypeptide
  ENST ID: ENST00000621953
  CDS Start-End: 341-1255
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattgttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctga

SEQ ID NO: 114621 - DNA, 826 bp, Homo sapiens
  Payload ID: 2400
  Gene Symbol: CSNK2B
  Gene Name: casein kinase 2, beta polypeptide
  ENST ID: ENST00000615772
  CDS Start-End: 341-826
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgtgccgcatgtacttgttcctcaatagttcaggacttttggttcttccccaggctggactcttgacacctcacccttcctga

SEQ ID NO: 114622 - DNA, 1255 bp, Homo sapiens; identical to SEQ ID NO: 114620
  Payload ID: 2400
  Gene Symbol: CSNK2B
  Gene Name: casein kinase 2, beta polypeptide
  ENST ID: ENST00000615589
  CDS Start-End: 341-1255

SEQ ID NO: 114623 - DNA, 826 bp, Homo sapiens; identical to SEQ ID NO: 114619
  Payload ID: 2400
  Gene Symbol: CSNK2B
  Gene Name: casein kinase 2, beta polypeptide
  ENST ID: ENST00000613998
  CDS Start-End: 341-826

SEQ ID NO: 114624 - DNA, 1255 bp, Homo sapiens
  Payload ID: 2400
  Gene Symbol: CSNK2B
  Gene Name: casein kinase 2, beta polypeptide
  ENST ID: ENST00000619468
  CDS Start-End: 341-1255
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattgttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctga

SEQ ID NO: 114625 - DNA, 1181 bp, Homo sapiens
  Payload ID: 2400
  Gene Symbol: CSNK2B
  Gene Name: casein kinase 2, beta polypeptide
  ENST ID: ENST00000614974
  CDS Start-End: 13-699
gctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaaca

SEQ ID NO: 114626 - DNA, 826 bp, Homo sapiens; identical to SEQ ID NO: 114621
  Payload ID: 2400
  Gene Symbol: CSNK2B
  Gene Name: casein kinase 2, beta polypeptide
  ENST ID: ENST00000614783
  CDS Start-End: 341-826

SEQ ID NO: 114627 - DNA, 1255 bp, Homo sapiens; identical to SEQ ID NO: 114624
  Payload ID: 2400
  Gene Symbol: CSNK2B
  Gene Name: casein kinase 2, beta polypeptide
  ENST ID: ENST00000617578
  CDS Start-End: 341-1255

SEQ ID NO: 114628 - DNA, 1181 bp, Homo sapiens; identical to SEQ ID NO: 114625
  Payload ID: 2400
  Gene Symbol: CSNK2B
  Gene Name: casein kinase 2, beta polypeptide
  ENST ID: ENST00000621203
  CDS Start-End: 13-699

SEQ ID NO: 114629 - DNA, 1181 bp, Homo sapiens; identical to SEQ ID NO: 114618
  Payload ID: 2400
  Gene Symbol: CSNK2B
  Gene Name: casein kinase 2, beta polypeptide
  ENST ID: ENST00000622139
  CDS Start-End: 13-699

SEQ ID NO: 114630 - DNA, 4695 bp, Homo sapiens
  Payload ID: 2401
  Gene Symbol: CLPX
  Gene Name: caseinolytic mitochondrial matrix peptidase chaperone subunit
  Uniprot ID: O76031
  ENST ID: ENST00000300107
  CDS Start-End: 190-2091
actctggtgaatagacggctgtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgagccacgaaatgctgttattcctcagtaccaggccttattcagcatggataagtgtgaactgaatgttactgaggatgctttgaaagctatagccagattggcactagaacgaaaaacaggtgcacgaggccttcggtccataatggaaaagctgttactagaaccaatgtttgaagtccctaattctgatatcgtatgtgtggaggttgacaaagaagtagtagaaggaaaaaaggaaccaggatacatccgggctccaacaaaagaatcctctgaagaggagtatgactctggagttgaagaagaaggatggccccgccaagcagatgctgcaaacagctaaactgtcatattgctgtcttgtatatacagcttttccttcttttgtttaggatcataattgtctctacagtctgatattaaaggcattggatctatcttggatatcatacatggtcagagaagcctttaggagaagaatcagatcatgtatataattgtaacatcacattgattttacggaagatgttatatggactttaatgacacaatgtttagagataaaatgtacattattttggttcagttttttaaaaaaaatatgctttaacaaaattcttaggaattcttttaagcaatgcaggtattgcgataactgtagattttacaataatgttactctacaaatgggaaaataaattctttaaaattgaatattgagataccattctttagtgttaccttttttacccacatgtgtttctgaaaatattggaattttattcatcttaaaaattggaccaggtaggccgggcgtggtggctcacgcctgtaatcccagcactttgggaggccaaggcgggtggatcacgaggtcaggagttcaagaccagcctggccaagatggtgaaaccccatctctactaaaaatatgaaaaattagctgggtgccgtggcaggtgcctgtaatcccagctactcgggaggctgaggcaggagaatcgcttgaactcggagggcagagtttacagtgagctgaggttgtgccactgcactccagcctgggcgacaaagtgagactccgtctcagggcgaaaacaaaaaattggaccaggtagttttcaagtagttaaacatttcattgaaaaataccctgaagaactatattttgataattggtttagctgtattcctagtcttatctgctaatgcatgacactaacttcccaattggttctgtaaaaaaggccattttcttaccaagttgtctgatttatttaccatcttttttttttttttttttttaattgagcggagtctcacgctgtcccaagctgaagtgcagtggtgcgatcttggctcactgcaacctccgcctcccaggttcaagcaattttcctgcctcagccttccaagtagctgggattataggcacgcaccaccacacctggctaatttttgtatttttagtagagacagggtttcaccctgttggccaggctagtctgtaactcctgaccttgtgatctgctggcctcagcctcccaaagtgctgggattgcaggcgtaagccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaa

SEQ ID NO: 114631 - DNA, 533 bp, Homo sapiens
  Payload ID: 2401
  Gene Symbol: CLPX
  Gene Name: caseinolytic mitochondrial matrix peptidase chaperone subunit
  ENST ID: ENST00000559218
  CDS Start-End: 143-533
aagccccggggcccgcaggacagcggcgggagagatggggagaagtcccgcaggagttggttcggaagtacttgggtgtttcagcagtcctttgctggctttcccaacttgaccgggaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaac

SEQ ID NO: 114632 - DNA, 2228 bp, Homo sapiens
  Payload ID: 2401
  Gene Symbol: CLPX
  Gene Name: caseinolytic mitochondrial matrix peptidase chaperone subunit
  ENST ID: ENST00000559152
  CDS Start-End: 64-870
gattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaagtaagcagttgagtattttgttcaagcccactaaaaggaagggaatacatcaacctcccaaatattggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgagccacgaaatgctgttattcctcagtaccaggccttattcagcatggataagtgtgaactgaatgttactgaggatgctttgaaagctatagccagattggcactagaacgaaaaacaggtgcacgaggccttcggtccataatggaaaagctgttactagaaccaatgtttgaagtccctaattctgatatcgtatgtgtggaggttgacaaagaagtagtagaaggaaaaaaggaaccaggatacatccgggctccaacaaaagaatcctctgaagaggagtatgactctggagttgaagaagaaggatggccccgccaagcagatgctgcaaacagctaaactgtcatattgctgtcttgtatatacagcttttccttcttttgtttaggatcataattgtctctacagtctgatattaaaggcattggatctatcttggatatcatacatggtcagagaagcctttaggagaagaatcagatcatgtatataattgtaacatcacattgattttacggaagatgttatatggactttaatgacacaatgtttagagataaaatgtacattattttggttcagttttttaaaaaaaatatgctttaacaaaattcttaggaattcttttaagcaatgcaggtattgcga

SEQ ID NO: 114633 - DNA, 1155 bp, Homo sapiens
  Payload ID: 2402
  Gene Symbol: CLPP
  Gene Name: caseinolytic mitochondrial matrix peptidase proteolytic subunit
  Uniprot ID: Q16740
  ENST ID: ENST00000245816
  CDS Start-End: 124-957
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtctttgctctg

SEQ ID NO: 114634 - DNA, 646 bp, Homo sapiens
  Payload ID: 2402
  Gene Symbol: CLPP
  Gene Name: caseinolytic mitochondrial matrix peptidase proteolytic subunit
  ENST ID: ENST00000596605
  CDS Start-End: 70-240
ccccagggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctgggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 114635 - DNA, 480 bp, Homo sapiens
  Payload ID: 2402
  Gene Symbol: CLPP
  Gene Name: caseinolytic mitochondrial matrix peptidase proteolytic subunit
  ENST ID: ENST00000597326
  CDS Start-End: 1-480
tcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgcc

SEQ ID NO: 114636 - DNA, 745 bp, Homo sapiens
  Payload ID: 2402
  Gene Symbol: CLPP
  Gene Name: caseinolytic mitochondrial matrix peptidase proteolytic subunit
  ENST ID: ENST00000596149
  CDS Start-End: 129-701
ggctccgggctgggtggggatcggctggctgccccggcccctcacctccatctttctacccccagggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcc

SEQ ID NO: 114637 - DNA, 5759 bp, Homo sapiens
  Payload ID: 2403
  Gene Symbol: CASKIN1
  Gene Name: CASK interacting protein 1
  Uniprot ID: Q8WXD9
  ENST ID: ENST00000343516
  CDS Start-End: 94-4389
cgggggaggcggccggtgccgcggggccgccgccgcctctgagccgcgccgagctcacgagcgcagccgcgtcgctgcggccccggccgcgccatggggaaggagcaggagctggtgcaggcggtgaaggcggaggacgtagggaccgcgcagaggctgctgcagaggccgcggcccgggaaggccaagctcctgggttccaccaagaagatcaatgtcaacttccaggacccggatggcttctcggctctgcaccatgcggccctgaacggcaacacggaattgatcagcctgctgctggaggcccaggccgctgtggacatcaaggacaacaaaggcatgcggccgctgcactatgcggcctggcagggccggaaggagcccatgaagctggtgctgaaggcgggctcggccgtgaacatcccgtctgatgagggccacatccccctgcacctggcggcccagcatggtcactatgatgtgtctgagatgctgctacagcaccagtctaacccgtgcatggtggacaactcggggaagacgcccctggacctggcctgcgagttcggccgcgttggggtggtccagctgctcctcagcagcaatatgtgtgcggcgctgctggagccccggccgggagacgccaccgaccccaacggcaccagccctttgcacctcgcagctaaaaacggccacatcgacatcatcaggctcctcctccaagccggcatcgacattaaccgccagaccaagtccggcacggccctgcacgaggctgcgctctgcggaaagacagaggtggtgcggctgctgctggatagcgggatcaatgcccacgtgaggaacacctacagccagacagccctggacatcgtgcaccagttcaccacgtcccaggccagcagggagatcaagcagctgttgcgagaggcctcagcggccctgcaggtccgggcgaccaaggattattgcaacaattacgacctgaccagcctcaacgtgaaggcaggggacatcatcacagtcctcgagcagcatccggatggccggtggaagggctgcatccatgacaaccggacgggcaatgaccgggtgggctacttcccgtcctccctgggcgaggccattgtcaagcgagcaggttcccgagcaggcactgaaccaagcctgccccagggaagcagctcatcgggaccctctgcacccccagaggagatctgggtgctgaggaagccttttgcaggtggggaccgaagcggcagcattagcggcatggctggcggccggggcagcgggggtcacgccctacacgcgggctctgaaggcgtcaagctcctggcaacggtgctttcccagaagtccgtctctgagtccggcccgggggacagccccgccaagcctccggaaggctctgcaggtgtggcccggtcccagcctccagtggcccacgccgggcaggtctatggggagcagccgcccaagaagctggagccagcatcggagggcaagagctctgaggccgtgagccagtggctcaccgcgttccagctgcagctctacgcccccaacttcatcagcgccggctacgacctgcccaccatcagccgcatgactcccgaggacctcacggccattggtgtcaccaagccgggccaccggaagaagatcgcggcagagatcagcggcctaagcatccctgactggctgcctgagcacaaacccgctaacctggccgtgtggctgtccatgatcggcctggcccagtactacaaggtgttggtggacaatggctacgagaacattgatttcatcaccgacatcacctgggaggacctgcaggagatcggcatcaccaagctggggcaccagaagaagctgatgctcgctgtgaggaagctggcagagctgcagaaggctgaatacgccaagtatgaggggggccccctgcgccggaaggcgccccagtctcttgaagtgatggccatcgagtcgccgcccccgcctgagcccacaccggccgactgccagtcccctaaaatgaccaccttccaggacagcgagctcagtgacgagctgcaggctgccatgactggcccggctgaggtggggcccaccactgagaagccctccagccacctgccacccaccccgagggccaccacgcggcaggactccagcctgggtggtcgggcacggcacatgagcagctcgcaggagctgctgggagatgggccccctgggcccagcagccccatgtctcgaagccaggagtacctcctggatgagggccccgcccccggcaccccgcccagggaggcccggcccggccgccacggccacagcatcaagagggccagcgtgccccccgtgcctggcaagccacggcaggtcctcccaccaggcactagccacttcacgcccccccagacgcccaccaaaacccgaccaggctctccccaggcccttgggggacctcatggtccagccccagctacggccaaggtgaagcccaccccgcagctgctgccgccgacagagcgccccatgtcaccccgctccctgcctcagtcaccgacgcaccgcggctttgcctacgtgctgccccagcccgtggagggcgaggtggggccggctgccccggggcctgcgcccccacccgtgccgacggctgtgcccacactgtgcctgccccctgaggccgacgcggagccggggcggcccaagaagcgggcccacagcctgaatcgctatgcggcgtccgacagcgagccggagcgggacgagctgctggtgcctgcggctgccggcccctatgccacggtccagcggcgcgtgggccgcagccactcagtgagggcgcccgcaggtgccgacaagaacgtcaaccgcagccagtcctttgccgtgcggccccgaaagaaggggcccccgccgcccccacccaagcgctccagctcggccctggctagtgccaacctggcggatgagccggtgcctgacgccgagcctgaggatggcctgctgggggtccgggcacagtgccggcgggccagtgacctggccggcagcgtggacacgggtagtgccggcagtgtgaagagcatcgcggccatgctggagctgtcctccattgggggtgggggccgggctgcccgcaggcctcctgagggccaccccactccccgccctgccagcccagagccgggccgggtggccaccgtgctggcctcagtgaaacacaaagaggccatcgggcctggcggggaggtggtgaaccggcgccgcacgctcagcgggccagtcaccggacttctggccactgcccgccgggggcctggggagtcggcagacccaggcccctttgtggaggatggcactggccggcagcggcctcggggtccctccaagggcgaggcgggtgtcgaaggcccgcccttggccaaggtggaagccagcgccacactcaagaggcgcatccgggccaagcagaaccagcaggagaacgtcaagttcatcctgaccgagtctgacacggtcaagcgcaggcccaaggccaaggagcgggaggccgggcctgagccaccaccgccactgtccgtgtaccataatggcactggcaccgtgcgccgccgaccggcctcggagcaggctgggcctccggagctgcctccaccgcccccgcctgccgaacccccgcccaccgacctggcgcacctacccccattgcccccgcccgagggcgaagcccggaagccggccaagccgcctgtctctcccaagcccgtcctgacgcagcctgtgcccaagctccagggctcgcccacacccacctccaagaaggtgccgctgccaggccctggcagcccagaggtgaagcgcgcccacggcacgccaccgcccgtgtctcccaagccgccgccgccgcccacagcgcccaagcccgtcaaggcggtcgcggggctgccttcgggcagcgccggcccttcacccgcaccctcgcccgcgcgacagccgcccgccgccctcgccaagccgcccggtacgccgccctcgctgggcgccagccccgccaagcccccgtcccccggcgcgcccgcgctgcacgtgcccgccaagcccccgcgagccgccgccgccgccgccgccgccgccgccgcgccccccgccccgcccgaaggcgcctcgccaggggacagcgcccggcagaaactggaggagacaagcgcgtgcctggccgcggcgctgcaggcggtggaggagaagatccggcaggaggacgcgcagggcccgcgcgactcggcggcggaaaagagcactggcagcatcctggacgacatcggcagcatgttcgacgacctggccgaccagctggatgccatgctggagtgaacgccgcctggccgggccctcccgcgccgcccgggccctccccgcacactgacctatacctcaggatgggcgcgtctgggcgcggcgcgagcggccgggcagggccctgcagaagcacaactccggcccctggacccgggccggggcgcccaccggggaccgcctggccgggggctccaagggctctaggcagaccctgcgcccgcgggtcctccccacctgctgctccccgtgcaatacctgctgggcctcctgcccgcgcgggaggggagggcgccccgggaccagggatggggcagcgcacaggcccgggcccagcacagaactgcccatcgggacgcccggccagccgctcgggcgcagcacaagggacaggggaccaaggtcagggcccccctgccccaccgcacccccagaatataagctatcaagagtattaatttattgggaatgagctgaggcggatttccccagagaaacaaaaaggtataactttaacaaatatatatttaaagaaagaaatattattgattctatagaaaaccatttaccaactgaaaggacacgaagtctagctccggacaaaagctgttagaggcccaggctgtctgcctgcggtccttcctccggccagagtggaggccccaggctgctagcacaggtggaaggctggggcccgggggcgggtgctctgccgggggctcctccgtgcttctctcctaagttctctgcgccccaagaactcgaggttgtgccttgctctcggcggccgtgtcctcctcctggcgtggctgcgtcccagggcgcgggtgggtttggtgaatgtgggtgtgtcagcgtggcagccacgtggaagcagggcatgtagcaggccaggccacgggcttgcagctcctctgagggtgtgcctggccccctctccaggggctgtgcaggcagcccatccaccccagtggagttcccacggacgcttctgctcatggtccaaggctgtgttgtgtggtcattctcgccctcccttttcctctctcctcctgccccctccaagaagtactgactggtctcctctatcgtgtttgctgatccacagtgttgggcacaactttgacgtttcttaaaaaaaaaatttaaaaaatgccgaaaaccagcgattgtggtgtggggcgggtggaggcggctggcggaggtggcgtcccggcgtgcagggccccttcctgctgtctcaccccgtgtttccctgcgagtggacgtgcccagctgtccccccaggcctctcctcagagggcggcacaggctgggctccagcaggtgggcaggggaggtctgggcaaggcgctgccgtcggctgtcaataaacagcaggaaacaga

SEQ ID NO: 114638 - DNA, 5015 bp, Homo sapiens
  Payload ID: 2404
  Gene Symbol: CASKIN2
  Gene Name: CASK interacting protein 2
  Uniprot ID: Q8WXE0
  ENST ID: ENST00000321617
  CDS Start-End: 588-4196
gacggtccctccgttcccgatccggcgggagggaggggggaggggcgggatttcctgcgggaggcgccgagccggccttggaaaaggagaaggagaaaggggggcaggggggagtgggagccaccgtcctgagtgccagggaccgagcagggccagccggaccccggcgggcggccgggagagagccctgagaccagtgcaccgctgctgcctgaggcccaagggaatgctggctgctctctgggtgggcactggtgttccacagccaagccgggaagattggtgtgcccagtcccagcccatcctggagctgtcggaagccacaagctgatatccatccagatttccatgtagccttcaccccctcaaagattagctttccttcgtgtggtggcagttcacggagcacctttgggagtatccctcagtacctgacgaggagcccactgcctgggacacctgacttgctcccccggaaccgggagccctccaaggggctgtggcatggcgccctgacgccccagcttggacccgttgcctgcctttgccctggactcctgagtgtagagctcagcccaggagccagtatgggtcgtgaacaggacctgatcctcgccgtcaagaatggagatgtgaccggtgtgcagaaactggtggcgaaggtcaaggccacaaagacaaagctcctgggctccacaaagaggctcaacgtgaactaccaggatgctgatggattctctgccctccaccacgctgctttggggggcagcctggagctcatagccttgctgctagaggctcaggccactgttgacatcaaggacagcaatggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtgtcagaaatgctcctccagcatcagtccaacccatgcctggtcaacaaggccaagaagacgcccctggacctggcctgtgaatttggccgactcaaggtggcccagctgcttctgaacagccacttatgtgtggcactgctggagggtgaggccaaagacccgtgtgaccccaactacaccacgcccctgcacttggctgccaagaatggccacagagaagtcatcaggcagctcctgagagctgggatcgagatcaaccgccagaccaagacgggtacggcgctccacgaggccgcactgtatggcaagaccgaggtggtgcggctgcttctggagggaggtgtggacgtgaacatccggaatacgtataaccagacggcgctggacatagtgaatcagttcaccacctcccaggccagccgggaaatcaagcagctactgcgggaggcctcagggatcctgaaggtccgagcgctcaaggatttctggaacctccacgatcccactgctctcaatgtccgggcaggggatgtcatcacggtgctagaacagcatcccgacggccgctggaagggccacatccacgagagccagaggggcacagaccgcataggctacttccccccgggcattgtcgaggtggtcagcaagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccagcaggtgacaggaatagtgtgggcagtgagggcagcgtgggcagcatccgcagtgccggcagcgggcagagctctgagggcactaatggccatggccctggcctcctgattgagaacgcccagccactgccctctgctggagaggaccaggtgctgccaggactccacccgccgtccctggcagacaacctgagccaccgccctctggccaactgccgctctggggagcagatcttcacccaggacgtgcggccagaacagctgctggaggggaaggacgcgcaggccattcataactggctaagcgagttccagctggagggctacactgcccactttctgcaggccggctatgatgtgcctaccatcagccgcatgacacctgaggacctgacggccatcggggtgaccaagcctgggcacaggaagaagatcgcctcagagatcgctcagctcagcatcgccgagtggctgcccagctacatcccaacggacctgctggagtggctgtgtgcactggggctgccacagtaccacaagcagctggtgagcagcggctacgactccatggggctggtggccgacctcacctgggaggagctgcaggagattggggtcaacaagctcgggcatcagaagaagctcatgctgggggtgaagcggctggcggagcttcggcggggcctgctgcagggggaggccctcagcgaaggcgggcgccggctggccaagggtccggagctgatggccatcgagggactggagaacggagaaggcccagctacagctggcccacggctcctcaccttccagggcagcgaactaagcccagagctacaggcggccatggcagggggtggccctgaaccactccccctcccacctgcccgctctcccagccaggagagcatcggggcacgctcacgggggtctggccactcacaggaacagcctgccccacagcccagcggtggagatcccagccccccccaggagaggaacctcccagagggcacagagcggccccctaagctttgttcttcacttcctggccaaggacccccaccctatgtttttatgtacccccagggctcaccctctagcccggccccagggccacctcctggcgcaccctgggccttctcctacttggccgggccccctgccactcccccagacccgcctcgacctaagcgccggtcccacagcctaagccgccctggccccacagagggggatgctgagggggaggccgaagggccagtgggcagcaccctaggcagttatgctacccttacccggcggccaggacgcagtgcccttgtccggaccagtcctagtgtgaccccaaccccagctcgggggactcctcgcagccagtcctttgccctgcgggcccggcgcaaaggccccccgcccccgccccccaagcgcctcagctccgtctctggccccagcccggagccacctccactagatgagagcccagggcccaaggaaggggccacagggccccgaaggcgaacactgagtgaacctgctggcccctcagagccccctggcccacctgccccggctgggcccgcgtcagacacggaggaggaggagccaggccctgaggggacgcccccatctcggggcagctctggggaagggctgccgtttgcagaggaagggaacctgaccatcaaacagcgcccgaagcccgctggccccccgccccgagagacacccgtgccccccggcctcgatttcaacctcacggaatcagacactgttaagcggaggcccaagtgccgggagagagagccactgcagaccgcactgctggccttcggagtggccagtgccacgcctggccccgctgccccactgccttccccaactcctggcgagtctcctccagcttctagccttccccagcccgagcccagcagccttccagcccaaggagttccaaccccccttgctcccagccccgccatgcagcctccagtgccgccctgcccagggccaggtctggaaagctcagcagctagtcggtggaatggggagacagaacccccggccgcccctgctgccctcctcaaggtgcccggagcaggaacagcccccaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctggacagggaccctggtaagagctctctcctcagggaggaagtaggggtggggctttgggggtgctttctctgtaccccccagcccatgtcccaagttgtgccaagggaatgcctcttgccacccaccatcctgcccaggccctgagaggctggaggaggcgtgtgtctggccgggccccctctccgtaggtgtacagaggacatgtaaatacacagcggtggtgcccaggcagctcctgcccccgccttccctcactgaggcagggctagcaggggtgggaggcagtggggttaacagatcccacaagtcctaacttttcaattgtaaatgttattttctaagcagagagaaatgcatatattttaaatggaatttattctatcaactgcctgagaggacacaatgggggaggggcttcggaccacagcaggagccccgactgcccacctgagggcagggagagcctgaccccattggcccaggccctggctctgtaaccattaacctcttcccccaactaacaccaatgaaaacaccattccacgtga

SEQ ID NO: 114639 - DNA, 3950 bp, Homo sapiens
  Payload ID: 2404
  Gene Symbol: CASKIN2
  Gene Name: CASK interacting protein 2
  Uniprot ID: Q8WXE0
  ENST ID: ENST00000433559
  CDS Start-End: 317-3679
ttgtcctgctcctctcgggagggactgcatcccgccacccagctgcctcatcccaaactgtccaggctgttggaagaggagggctaatggaagagtgggcagcttgaagggtgctctgtgtctcttccctgctgaccgcattgtctccactggggctcagagagagctcctgggctccacaaagaggctcaacgtgaactaccaggatgctgatggattctctgccctccaccacgctgctttggggggcagcctggagctcatagccttgctgctagaggctcaggccactgttgacatcaaggacagcaatggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtgtcagaaatgctcctccagcatcagtccaacccatgcctggtcaacaaggccaagaagacgcccctggacctggcctgtgaatttggccgactcaaggtggcccagctgcttctgaacagccacttatgtgtggcactgctggagggtgaggccaaagacccgtgtgaccccaactacaccacgcccctgcacttggctgccaagaatggccacagagaagtcatcaggcagctcctgagagctgggatcgagatcaaccgccagaccaagacgggtacggcgctccacgaggccgcactgtatggcaagaccgaggtggtgcggctgcttctggagggaggtgtggacgtgaacatccggaatacgtataaccagacggcgctggacatagtgaatcagttcaccacctcccaggccagccgggaaatcaagcagctactgcgggaggcctcagggatcctgaaggtccgagcgctcaaggatttctggaacctccacgatcccactgctctcaatgtccgggcaggggatgtcatcacggtgctagaacagcatcccgacggccgctggaagggccacatccacgagagccagaggggcacagaccgcataggctacttccccccgggcattgtcgaggtggtcagcaagcgggtgggcatccctgcagcccgcctcccctccgcacccacccccctgcgcccaggcttctcccggacaccgcagcctcctgccgaagaacccccgcaccctcttacctacagccagcttcctcgggtgggcctcagcccagacagcccagcaggtgacaggaatagtgtgggcagtgagggcagcgtgggcagcatccgcagtgccggcagcgggcagagctctgagggcactaatggccatggccctggcctcctgattgagaacgcccagccactgccctctgctggagaggaccaggtgctgccaggactccacccgccgtccctggcagacaacctgagccaccgccctctggccaactgccgctctggggagcagatcttcacccaggacgtgcggccagaacagctgctggaggggaaggacgcgcaggccattcataactggctaagcgagttccagctggagggctacactgcccactttctgcaggccggctatgatgtgcctaccatcagccgcatgacacctgaggacctgacggccatcggggtgaccaagcctgggcacaggaagaagatcgcctcagagatcgctcagctcagcatcgccgagtggctgcccagctacatcccaacggacctgctggagtggctgtgtgcactggggctgccacagtaccacaagcagctggtgagcagcggctacgactccatggggctggtggccgacctcacctgggaggagctgcaggagattggggtcaacaagctcgggcatcagaagaagctcatgctgggggtgaagcggctggcggagcttcggcggggcctgctgcagggggaggccctcagcgaaggcgggcgccggctggccaagggtccggagctgatggccatcgagggactggagaacggagaaggcccagctacagctggcccacggctcctcaccttccagggcagcgaactaagcccagagctacaggcggccatggcagggggtggccctgaaccactccccctcccacctgcccgctctcccagccaggagagcatcggggcacgctcacgggggtctggccactcacaggaacagcctgccccacagcccagcggtggagatcccagccccccccaggagaggaacctcccagagggcacagagcggccccctaagctttgttcttcacttcctggccaaggacccccaccctatgtttttatgtacccccagggctcaccctctagcccggccccagggccacctcctggcgcaccctgggccttctcctacttggccgggccccctgccactcccccagacccgcctcgacctaagcgccggtcccacagcctaagccgccctggccccacagagggggatgctgagggggaggccgaagggccagtgggcagcaccctaggcagttatgctacccttacccggcggccaggacgcagtgcccttgtccggaccagtcctagtgtgaccccaaccccagctcgggggactcctcgcagccagtcctttgccctgcgggcccggcgcaaaggccccccgcccccgccccccaagcgcctcagctccgtctctggccccagcccggagccacctccactagatgagagcccagggcccaaggaaggggccacagggccccgaaggcgaacactgagtgaacctgctggcccctcagagccccctggcccacctgccccggctgggcccgcgtcagacacggaggaggaggagccaggccctgaggggacgcccccatctcggggcagctctggggaagggctgccgtttgcagaggaagggaacctgaccatcaaacagcgcccgaagcccgctggccccccgccccgagagacacccgtgccccccggcctcgatttcaacctcacggaatcagacactgttaagcggaggcccaagtgccgggagagagagccactgcagaccgcactgctggccttcggagtggccagtgccacgcctggccccgctgccccactgccttccccaactcctggcgagtctcctccagcttctagccttccccagcccgagcccagcagccttccagcccaaggagttccaaccccccttgctcccagccccgccatgcagcctccagtgccgccctgcccagggccaggtctggaaagctcagcagctagtcggtggaatggggagacagaacccccggccgcccctgctgccctcctcaaggtgcccggagcaggaacagcccccaagcctgtgtcggtggcctgcacccagctggcattttctggccctaagctagcgccccggctcggcccccgcccagtgcctcctccacggcctgagagcactgggactgtgggcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagtgcccctcctagcagggccccttcccactcagcccgcggctgtgggcaccacagctcttgtggggcagcccaccttagaacctgactagcgagggacctccgctgcatctcagcaaagcccctcccagggtttgatcgattgagcaggacagccctgctcctg

SEQ ID NO: 114640 - DNA, 530 bp, Homo sapiens
  Payload ID: 2404
  Gene Symbol: CASKIN2
  Gene Name: CASK interacting protein 2
  ENST ID: ENST00000580075
  CDS Start-End: 454-530
tacctcgggcgcttggcccgcccggcttctcccgccgctttgttccccgagccctgagaccagtgcaccgctgctgcctgaggcccaagggaatgctggctgctctctgggtgggcactggtgttccacagccaagccgggaagattggtgtgcccagtcccagcccatcctggagctgtcggaagccacaagctgatatccatccagatttccatgtagccttcaccccctcaaagattagctttccttcgtgtggtggcagttcacggagcacctttgggagtatccctcagtacctgacgaggagcccactgcctgggacacctgacttgctcccccggaaccgggagccctccaaggggctgtggcatggcgccctgacgccccagcttggacccgttgcctgcctttgccctggactcctgagtgtagagctcagcccaggagccagtatgggtcgtgaacaggacctgatcctcgccgtcaagaatggagatgtgaccggtgtgcagaaactggtggcgaaggt

SEQ ID NO: 114641 - DNA, 1612 bp, Homo sapiens
  Payload ID: 2404
  Gene Symbol: CASKIN2
  Gene Name: CASK interacting protein 2
  ENST ID: ENST00000581870
  CDS Start-End: 445-1416
cgagcagggccagccggaccccggcgggcggccgggagagagccctgagaccagtgcaccgctgctgcctgaggcccaagggaatgctggctgctctctgggtgggcactggtgttccacagccaagccgggaagattggtgtgcccagtcccagcccatcctggagctgtcggaagccacaagctgatatccatccagatttccatgtagccttcaccccctcaaagattagctttccttcgtgtggtggcagttcacggagcacctttgggagtatccctcagtacctgacgaggagcccactgcctgggacacctgacttgctcccccggaaccgggagccctccaaggggctgtggcatggcgccctgacgccccagcttggacccgttgcctgcctttgccctggactcctgagtgtagagctcagcccaggagccagtatgggtcgtgaacaggacctgatcctcgccgtcaagaatggagatgtgaccggtgtgcagaaactggtggcgaaggtcaaggccacaaagacaaagctcctgggctccacaaagaggctcaacgtgaactaccaggatgctgatggattctctgccctccaccacgctgctttggggggcagcctggagctcatagccttgctgctagaggctcaggccactgttgacatcaaggacagcaatggcatgcgcccgctgcactacgcagcctggcagggccggctggagcctgtgaggctgctgctgcgcgcctctgcggctgtcaatgccgcctcgctggacggacagatccccctgcacctggctgcacagtatggacattatgaggtgtcagaaatgctcctccagcatcagtccaacccatgcctggtcaacaaggccaagaagacgcccctggacctggcctgtgaatttggccgactcaaggtggcccagctgcttctgaacagccacttatgtgtggcactgctggagggtgaggccaaagacccgtgtgaccccaactacaccacgcccctgcacttggctgccaagaatggccacagagaagtcatcaggcagctcctgagagctgggatcgagatcaaccgccagaccaagacgggtacggcgctccacgaggccgcactgtatggcaagaccgaggtggtgcggctgcttctggagggaggtgtggacgtgaacatccggaatacgtataaccagacggcgctggacatagtgaatcagttcaccacctcccaggccagccgggaaatcaagcagctactgcgggaggcctcagggatcctgaaggtccgagcgctcaaggatttctggaacctccacgatcccactgctctcaatgtccgggcaggggatgtcatcacggtgagggaccccaagcaggcattcctttgcaaatacaaatgattgctgttacttatttgggcacctgctatgttaccacgttctgctctgaggtctctatatgcaccctcatttaattcttcttaaagccagggaaggcagtgctgttagcatttcttctttacagatgacaaaattgagaattaaacaaaataaaatcaagagaaattcaagtgacttgcccaaggtcacacagcta

SEQ ID NO: 114642 - DNA, 1169 bp, Homo sapiens
  Payload ID: 2405
  Gene Symbol: CRADD
  Gene Name: CASP2 and RIPK1 domain containing adaptor with death domain
  Uniprot ID: P78560
  ENST ID: ENST00000332896
  CDS Start-End: 105-704
gccattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataa

SEQ ID NO: 114643 - DNA, 1403 bp, Homo sapiens
  Payload ID: 2405
  Gene Symbol: CRADD
  Gene Name: CASP2 and RIPK1 domain containing adaptor with death domain
  Uniprot ID: P78560
  ENST ID: ENST00000542893
  CDS Start-End: 319-918
aagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctgggggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaa

SEQ ID NO: 114644 - DNA, 1293 bp, Homo sapiens
  Payload ID: 2405
  Gene Symbol: CRADD
  Gene Name: CASP2 and RIPK1 domain containing adaptor with death domain
  Uniprot ID: P78560
  ENST ID: ENST00000551065
  CDS Start-End: 81-392
ggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagggtgttggccatgatccttatgatggggaggaagggaatcaccaattttctaccccatcccactgagcaacttagagatgacctaaggcctcgttacctgtgtggagtaactgggaattggaagagatgaggaaactgaggccaaaggattctgttacttgcctggcttcacagctcacctggagattctgaactggcatcttcctctctctgccatcaccccagaccctaccctctttcctctacaccagtggttctcaatcaagggcgattttgccttccaggggacatttgacaatgtctggaggcgtttttggttgtcacaattctgtgtatgtgtgtgggtgggcggggggcaggggattatgttggcatctagtgagtagataacagagatgctgctaaacctacaatgctcagatggcccctaacaaagaagtatgttgtccaaaatgtcaatggtgcagagggtgagaagccctggtctatacagagctcagcagtccagagcaattgcaacctctgggagttgccaagagctcctctgcccagcaacaggcttggcctctctcctgtggctgccacaagagttaaagccactgtctggaatgccctttggcagtggccaagtgtcccctgcagaactgactgcgggacatgcggtgcatcagccggagctgatgtgttttgtaatttatagtcacagggcgcctgtcttcatttagcagtaggcctgctggcagcttccctgccagggaggaagcaagttccacagaggcccacagcccccgccagctgccggcccgtggtatttggggacggctgttgctcagagacacctgggaataggccggggccgagatggcgctgagcactcggtctccccttcagacccatccatcagcagcggtccct

SEQ ID NO: 114645 - DNA, 1056 bp, Homo sapiens
  Payload ID: 2405
  Gene Symbol: CRADD
  Gene Name: CASP2 and RIPK1 domain containing adaptor with death domain
  ENST ID: ENST00000548483
  CDS Start-End: 81-446
ggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagagatgaggaaactgaggccaaaggattctgttacttgcctggcttcacagctcacctggagattctgaactggcatcttcctctctctgccatcaccccagaccctaccctctttcctctacaccagtggttctcaatcaagggcgattttgccttccaggggacatttgacaatgtctggaggcgtttttggttgtcacaattctgtgtatgtgtgtgggtgggcggggggcaggggattatgttggcatctagtgagtagataacagagatgctgctaaacctacaatgctcagatggcccctaacaaagaagtatgttgtccaaaatgtcaatggtgcagagggtgagaagccctggtctatacagagctcagcagtccagagcaattgcaacctctgggagttgccaagagctcctctgcccagcaacaggcttggcctctctcctgtggctgccacaagagttaaagccactgtctggaatgccctttggcagtggccaagtgtcccctgcagaactgactgcgggacatgcggtgcatcagccggagctgatgtgttttgtaatttatagtcacagggcgcctgtcttcatttagcagtaggcctgctggcagcttccctgccagggaggaagcaagttccacagaggcccacagcccccgccagctgccgg

SEQ ID NO: 114646 - DNA, 839 bp, Homo sapiens
  Payload ID: 2405
  Gene Symbol: CRADD
  Gene Name: CASP2 and RIPK1 domain containing adaptor with death domain
  ENST ID: ENST00000552983
  CDS Start-End: 105-497
gccattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagggttagaggaaaaaggaaggactggccgaagaatggggtggggagctggagaagagaagggccaaaagtgtcagactgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgtaa

SEQ ID NO: 114647 - DNA, 622 bp, Homo sapiens
  Payload ID: 2405
  Gene Symbol: CRADD
  Gene Name: CASP2 and RIPK1 domain containing adaptor with death domain
  ENST ID: ENST00000552033
  CDS Start-End: 103-450
cattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactga

SEQ ID NO: 114648 - DNA, 14672 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000309955
  CDS Start-End: 516-1958
tttactcctaacgcgtggaacttgtgtcgacatccacccccggttactgcatactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcacttagcatgtttcaaggttcatctatgctatagagtgtaccagtgcttcattacattttatggctgaataataccctattgtgtggatataccgcatttagtttattcatcagttgatcgaaatttagactgtttccacttttttgctattatggatgatgctgctatgaatattcgtatatgaatttttatatggatatatgttttcagttcttctgggcatataccttagaagtgagagtgctcatcatatagtaactctatgtttagccttttgaggaactgccaaactgcttttcaaagtagtagcatcattttatattcccaccagcagtgtatgaggttttttttatttttttgtttttgagacggagtctcactctgtcgcccagggtggagtgcagtggcgttatcttgattcactgtaacctctgccttctgggttcaagccattctcctgcctcagcctccctagtagttgggagtagctgggtttacaggagctcgccaccatgcccaactaatttttgtattgttttttgagacggagtctcgctctgtggcccaggctggagtgcagtggtgcaatctcagctcactgcaagctccgcctcctgggttcatgccattctcctgcctcagcctcccaagtatctgggactacagccgccctccaccacgcccggctaattttttgtatttttagtagagacagggtttcaccgtgttagccaggatggtctctatctcctgacctcgtgatccgcctgccttggcctcccaaagtgctgggattacaggcgtgagccaccgcgcccagccaatttttgtatttttagtaaagacagggtttcaccatgttggccaggctggtctcgaactcctggcctcaggtgatctgactgccttggcttcccaaagtgctggcattacagacattagctactgtgcctggcctcaagtcctttctcattttaaaactgcgttattttattttatttttctgagatggaatctcactctgtcgcccaggttggagtgcagtggtgcaatctcggctcactgcaacctccacctcctgagttcaagcgactctcctgcctcggcctccctagtaactgggattacaggcacccaccatcacgcctggctaatttttgtatttttagtagagacagggtttcgccatgttggccaggctggtcttgaactcctgaactcaggtgatctgcctgcctcggcctcccaaaatgctaggattacaggcgtgagccaccacacccggtgggttgtctttttattgttgagttgtaagcattctttttaatattctggatactagtttcttatcaggtacaatctttgtgaatatattctcccattccatggattgtcttctcactttctggatactatacagtacaagttttaaattttgatgaagttcacttgatttctgttttttatgttattgcttatgcttttggtgtcatacctaaaaaaccattgtctaaatcaattgcctatgaggtgttacccctatgttttcttctaaagttttatgattttagctctttgacccattttgagttatttttgtgtatgcagtgcgagataagcatccagcctcattcttttgcacataaatgttcacttgtcttagcattacttattgaaaatactattttttccctatagaattattttatacttatcacaaatcaactaactataagggtttatttctggactcaattctgttgctctatcttatggtagtaccacactgtcttgattattgtaacttcgtagtaagttttggaatccagaaatgtagtcctctaactttgttgttgttgttgttcttcttttttcttttgtagagatgaggccttgctatgttgcccaggctggtctcaaactcctggcctcaaacaatcctcccacctccacctcccaaagtgctgaggggtgagccactgcaactggcctgttctttttcaaaattgttagggctgtattgggtttacctttccctaaattttcatataactgttaggattcacttgcaaatttatgtaaaaagggcctctggaattttgatagtgattacactgaatgagaggagtttggcaggactggtttcccaagaccacaagaccctgtaagaccctgctgataagacaggatgtggtagaaaggccaacccaaaccagccaaaaccatgatggtgacagaagagacctctggttacctttgctgcccattctatggtaattataatacattagcacgctaaaagaaacttctacagcaccatgatagtttacaactgccatagcaactttcagaagttaccctgtatggtctaaaaggtccagacctccccacttctttcctggaaaactcatgaataagccacctcttgtttagcgtatagtcaagaagcaaccataaatatagccagtcagcagcccatcagggctactcttcctatggggtagccattcttttattcctttactttcttaatgaacttgctttcactttattctgtcagcatgctcttgaattctttcctgaacccacttgacctcttgggctgagccttaaccttggggtacttttgcctataacaaacatacaaagataagtttggctgggcgcagtggctcatgcctgtaatcccaggactttgggaggctgaggatggtggatcgcttgagccaaggaatttgaggccaccttgggcaacacggcaaaaccctgtctctactaaaaatacaaaaattagctgggtatggtagcatgcgcctgtagtaccagctactcggaaggctgaggtgggaggatcacttgagcccgggaggtggaggtttcagtgagctgagattgtgccactgtactccagcctggggaacagagtgagaccctgtctcaaaataaaaataaatttgaggtgtattgccatcttaacggaagttgttactggtggacggtatccaagttactggtggtaaatctgcagcaacctcaattctttcctcctcagaagaaagaatttgactgaggggcataaggcagaaggagggaccgaggcaagtttcagagcaacagtgaaagtttattacgctttaggctgggcacagtggctcatgcctgtaatcccagcattttgggaggctgaggcaggtggattacttgaggtcagtagttcgagaccagcctggccatcatgatgatgaaacctcgtctctactaaaaatagaaaaatcagctgggcatggtggtccatgcctctaatcccagctactcgggaggctgaggcaggcgaatcagttgaacctgggaggcggaggttgcagtgagccaagaaagtttattaagctttagaacagtaaggaaaggaaagaaaagaaggaaagtataacttggaagagggccaagcaggtgacctgagaaaccaggtgcagggcttgccctcttgacttggggttttatatgctggcatacttccgggatcttgtgttacttttccccactcctgagatctttttgagaagctgatgatcagtctcaggtgttttctattgcggggggggggggcgggcgggggagctgcctgtccctggcaccacctgtgaccaattattactttacagaaacatttaacaaccgcctgaccatcacctgatggttgcccaacactcttggtgtgtgtcgggggagccctctcctgccttgctcagacctgaatgtacccattgtaacaaaccccttctttgtatactttgatatggtgacatttcttgtcacttgcctcattgtgaatttttatagatgtggctaagtcatatgcttccttctgaaaaattatgtcaaatactagcagtttctcactgttttttgccctagaaacaacaaactaaccttgaagtgaaaggcctttctgcgtttatcttaccttttttgagcagcattaaaactgttttactcagaccaa

SEQ ID NO: 114649 - DNA, 963 bp, Homo sapiens
  Payload ID: 2406
  Gene Symbol: CFLAR
  Gene Name: CASP8 and FADD-like apoptosis regulator
  ENST ID: ENST00000340870
  CDS Start-End: 1-963
atggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcagggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagg

SEQ ID NO: 114650 - DNA, 1283 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000341222
  CDS Start-End: 453-1118
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctt

SEQ ID NO: 114651 - DNA, 1613 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000342795
  CDS Start-End: 381-1259
ggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacaggttggagtgcaatggcgcaatctcagctcaccgcaatctccacctcccaggttcaagcgattctcctgcctcagcctcctgagtaactgggattacaggcatgtgccaccatgcccagctaattttgtatttttagtagagacaaggtttcaccatgtcggccaggctggtctcgatctcctgaccttgtgatctgcccacctcagcctcccaaagtgctacgattacaggcgtcagccatcatgcctggcttattctctccattttcaaggtgaggaagctgagcagtgaactacactcctaccttctctagtactgattgagctgggattcaaaagctggactccaaaacctatgcttttaactactttgcctcaatataatttccatgaaggtgagggagtttatctatctcctactatgggtctccagtacctgga

SEQ ID NO: 114652 - DNA, 2056 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000341582
  CDS Start-End: 413-1750
cgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttta

SEQ ID NO: 114653 - DNA, 4415 bp, Homo sapiens
  Payload ID: 2406
  Gene Symbol: CFLAR
  Gene Name: CASP8 and FADD-like apoptosis regulator
  ENST ID: ENST00000395148
  CDS Start-End: 213-965
gggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctct

SEQ ID NO: 114654 - DNA, 435 bp, Homo sapiens
  Payload ID: 2406
  Gene Symbol: CFLAR
  Gene Name: CASP8 and FADD-like apoptosis regulator
  ENST ID: ENST00000433445
  CDS Start-End: 242-435
cctttcgaaagttgttgggaacgtggactttcccaacaattgtgtatgcgctcgatctcactcagtgggagccgccgccctggagggaatttcacaatagcctgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatt

SEQ ID NO: 114655 - DNA, 1310 bp, Homo sapiens
  Payload ID: 2406
  Gene Symbol: CFLAR
  Gene Name: CASP8 and FADD-like apoptosis regulator
  ENST ID: ENST00000439154
  CDS Start-End: 376-1107
aacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcagggctggagtgcaatggcgcgatcttggctcaccgcaacctccgcctcccgggttcaagcgattctcccacctcagcctcccaagtagctgggattacaggaatgtgccaccacgcccggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcactt

SEQ ID NO: 114656 - DNA, 2128 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000423241
  CDS Start-End: 549-1991
cactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatac

SEQ ID NO: 114657 - DNA, 1198 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000440180
  CDS Start-End: 364-1029
tttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctttgtg

SEQ ID NO: 114658 - DNA, 596 bp, Homo sapiens
  Payload ID: 2406
  Gene Symbol: CFLAR
  Gene Name: CASP8 and FADD-like apoptosis regulator
  ENST ID: ENST00000425030
  CDS Start-End: 409-596
caatgatgaccagtctgttcaagacccaagagggctgagattggcagccctggccattgtttaccacagcctaatgaagatgagtaaaagcctatctatccccaaggacctccacatatgacagtactcaactgagtctcacataggatagaataagataaaatgctggaagagaacacaaatagtgctacaaagcaggaagagagacttgatttggggatcaagacaagcttatagaagagacatcttgagagagaagatataatttcagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgag

SEQ ID NO: 114659 - DNA, 1868 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000457277
  CDS Start-End: 1-1389
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggcctttt

SEQ ID NO: 114660 - DNA, 655 bp, Homo sapiens
  Payload ID: 2406
  Gene Symbol: CFLAR
  Gene Name: CASP8 and FADD-like apoptosis regulator
  ENST ID: ENST00000441224
  CDS Start-End: 269-655
cacagcggtacaagctgcaccccgatggacctgagagaccggaagtaacccttggccaactctggccgccccctgcagccgcagccccagaggcccacccgcgagcttcagtggcgggccctcagcgtcgtaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaag

SEQ ID NO: 114661 - DNA, 684 bp, Homo sapiens
  Payload ID: 2406
  Gene Symbol: CFLAR
  Gene Name: CASP8 and FADD-like apoptosis regulator
  ENST ID: ENST00000417748
  CDS Start-End: 330-684
agtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaataactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggatt

SEQ ID NO: 114662 - DNA, 1679 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000443227
  CDS Start-End: 336-1490
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggag

SEQ ID NO: 114663 - DNA, 693 bp, Homo sapiens
  Payload ID: 2406
  Gene Symbol: CFLAR
  Gene Name: CASP8 and FADD-like apoptosis regulator
  ENST ID: ENST00000494258
  CDS Start-End: 80-433
tcagaaactgttagttggcaaaggatgtaccatctcctattaaacgggcaaggacaagttcccttttctgagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcagggtgagtctggagaaaacatatggaatcccagcatgaaaccgtttcagagttctaataaaaatatgcatattctcacagcatgtactttatttaatatctgaaaaaattgtgatagaaatgtgtatttgttttaaaaacgtgtaacttcttatatttcaaagctaatacatgttcattgagatatttggagactatagagaaagataaaagaaaataaatcacctatattccactatccaaagacaaccactgttagtattttggtatatttccttctagactcttttttatgtggg

SEQ ID NO: 114664 - DNA, 588 bp, Homo sapiens
  Payload ID: 2406
  Gene Symbol: CFLAR
  Gene Name: CASP8 and FADD-like apoptosis regulator
  ENST ID: ENST00000462763
  CDS Start-End: 84-588
taggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacag

SEQ ID NO: 114665 - DNA, 516 bp, Homo sapiens
  Payload ID: 2406
  Gene Symbol: CFLAR
  Gene Name: CASP8 and FADD-like apoptosis regulator
  ENST ID: ENST00000470178
  CDS Start-End: 165-516
gggtgatctaggcttgctgttttatgagggagggacatatttacacaggggcaagaactagtcttttaatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctga

SEQ ID NO: 114666 - DNA, 1230 bp, Homo sapiens
  Payload ID: 2406
  Gene Symbol: CFLAR
  Gene Name: CASP8 and FADD-like apoptosis regulator
  Uniprot ID: O15519
  ENST ID: ENST00000479953
  CDS Start-End: 53-1153
aggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctc

SEQ ID NO: 114667 - DNA, 423 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000353247
  CDS Start-End: 45-311
atactttcagtttcagtcacacaagaagggaggagagaaaagccatggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 114668 - DNA, 948 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000446369
  CDS Start-End: 45-836
atactttcagtttcagtcacacaagaagggaggagagaaaagccatggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 114669 - DNA, 1477 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000436863
  CDS Start-End: 138-1352
ctttaatgggaagaaaaataaagacatgcatatgcatgcacagtgagtatttcccaatacatgtacaggccctgccaaaaaggaaggcgaagcatactttcagtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 114670 - DNA, 1392 bp, Homo sapiens
  Payload ID: 2407
  Gene Symbol: CASP1
  Gene Name: caspase 1, apoptosis-related cysteine peptidase
  ENST ID: ENST00000529871
  CDS Start-End: 35-367
tttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagatttaaaatgccctgaggagggtcattcaatgcttacatacatatatggttatacttgttgcagatggaagtactttttgtttttgtcacttattttgctatatttgttgtagttttttggcataactc

SEQ ID NO: 114671 - DNA, 1521 bp, Homo sapiens
  Payload ID: 2407
  Gene Symbol: CASP1
  Gene Name: caspase 1, apoptosis-related cysteine peptidase
  ENST ID: ENST00000527979
  CDS Start-End: 293-1396
ggaggagagaaaagccatggccgggactgatgtggaaatggtaaactcagtcttcaggtcactccatgcacatgtatggagactattgagggaaacaagtaggacagcaatacagtaagaagagggattacccaactgtgaggagggggacatttcactgatgaaatctaaatgaggtcactttctgttgattacatgagaggaatatgaggctgttttcatgatgtgagaaatccttgtgctctaaacagacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 114672 - DNA, 2001 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000533400
  CDS Start-End: 37-1251
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaa

SEQ ID NO: 114673 - DNA, 1061 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000526568
  CDS Start-End: 1-936
atggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 114674 - DNA, 1402 bp, Homo sapiens
  Payload ID: 2407
  Gene Symbol: CASP1
  Gene Name: caspase 1, apoptosis-related cysteine peptidase
  ENST ID: ENST00000528974
  CDS Start-End: 66-971
tttcagtcacacaagaagggaggagagaaaagccatggccgacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccaggcaagagccagtcttgagatttgaaatgtgctttatccatagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagattt

SEQ ID NO: 114675 - DNA, 300 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000531166
  CDS Start-End: 1-267
atggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcagg

SEQ ID NO: 114676 - DNA, 1237 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000525825
  CDS Start-End: 37-1188
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcg

SEQ ID NO: 114677 - DNA, 821 bp, Homo sapiens
  Payload ID: 2407
  Gene Symbol: CASP1
  Gene Name: caspase 1, apoptosis-related cysteine peptidase
  ENST ID: ENST00000532439
  CDS Start-End: 1-711
atttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggaagtgaagagatccttctgtaaaggtttttggaattatgtctgctgaataataaacttttttgaaataataaatctggtagaaaaatgaaaacttgtcctcatttttctcccacactgaagaaacagggactggaacttagagtgactaaggaattt

SEQ ID NO: 114678 - DNA, 825 bp, Homo sapiens
  Payload ID: 2407
  Gene Symbol: CASP1
  Gene Name: caspase 1, apoptosis-related cysteine peptidase
  Uniprot ID: P29466
  ENST ID: ENST00000534497
  CDS Start-End: 1-792
atggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcagg

SEQ ID NO: 114679 - DNA, 3926 bp, Homo sapiens
  Payload ID: 2408
  Gene Symbol: CASP10
  Gene Name: caspase 10, apoptosis-related cysteine peptidase
  Uniprot ID: Q92851
  ENST ID: ENST00000346817
  CDS Start-End: 148-1587
tgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaat

SEQ ID NO: 114680 - DNA, 2073 bp, Homo sapiens
  Payload ID: 2408
  Gene Symbol: CASP10
  Gene Name: caspase 10, apoptosis-related cysteine peptidase
  Uniprot ID: Q92851
  ENST ID: ENST00000272879
  CDS Start-End: 185-1750
tgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 114681 - DNA, 5928 bp, Homo sapiens
  Payload ID: 2408
  Gene Symbol: CASP10
  Gene Name: caspase 10, apoptosis-related cysteine peptidase
  Uniprot ID: Q92851
  ENST ID: ENST00000286186
  CDS Start-End: 436-2004
tccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaa

SEQ ID NO: 114682 - DNA, 1521 bp, Homo sapiens
  Payload ID: 2408
  Gene Symbol: CASP10
  Gene Name: caspase 10, apoptosis-related cysteine peptidase
  Uniprot ID: Q92851
  ENST ID: ENST00000313728
  CDS Start-End: 125-1492
ggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctc

SEQ ID NO: 114683 - DNA, 5814 bp, Homo sapiens
  Payload ID: 2408
  Gene Symbol: CASP10
  Gene Name: caspase 10, apoptosis-related cysteine peptidase
  Uniprot ID: Q92851
  ENST ID: ENST00000360132
  CDS Start-End: 419-1240
aaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcac

SEQ ID NO: 114684 - DNA, 1126 bp, Homo sapiens
  Payload ID: 2408
  Gene Symbol: CASP10
  Gene Name: caspase 10, apoptosis-related cysteine peptidase
  Uniprot ID: Q92851
  ENST ID: ENST00000374650
  CDS Start-End: 157-900
agcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctc

SEQ ID NO: 114685 - DNA, 1603 bp, Homo sapiens
  Payload ID: 2408
  Gene Symbol: CASP10
  Gene Name: caspase 10, apoptosis-related cysteine peptidase
  Uniprot ID: Q92851
  ENST ID: ENST00000448480
  CDS Start-End: 122-1558
gcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcc

SEQ ID NO: 114686 - DNA, 888 bp, Homo sapiens
  Payload ID: 2408
  Gene Symbol: CASP10
  Gene Name: caspase 10, apoptosis-related cysteine peptidase
  ENST ID: ENST00000438843
  CDS Start-End: 176-532
agttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatgagggcagctgtgtacaggatgaatcggaaccacagaggcctctgtgtcattgtcaacaaccacagctttacctccctgaaggacag

SEQ ID NO: 114687 - DNA, 1166 bp, Homo sapiens
  Payload ID: 2409
  Gene Symbol: CASP12
  Gene Name: caspase 12 (gene/pseudogene)
  Uniprot ID: Q6UXS9
  ENST ID: ENST00000458137
  CDS Start-End: 257-763
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagcttttctggaaatccagggtgcccaacccagtggcaagttaaagctttgtcctcatgctcacttccatgaactaaagacaaaaagggcagatgagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 114688 - DNA, 961 bp, Homo sapiens
  Payload ID: 2409
  Gene Symbol: CASP12
  Gene Name: caspase 12 (gene/pseudogene)
  ENST ID: ENST00000494737
  CDS Start-End: 257-937
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 114689 - DNA, 1071 bp, Homo sapiens
  Payload ID: 2409
  Gene Symbol: CASP12
  Gene Name: caspase 12 (gene/pseudogene)
  ENST ID: ENST00000448103
  CDS Start-End: 257-931
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 114690 - DNA, 1168 bp, Homo sapiens
  Payload ID: 2409
  Gene Symbol: CASP12
  Gene Name: caspase 12 (gene/pseudogene)
  ENST ID: ENST00000441710
  CDS Start-End: 257-1144
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 114691 - DNA, 1306 bp, Homo sapiens
  Payload ID: 2409
  Gene Symbol: CASP12
  Gene Name: caspase 12 (gene/pseudogene)
  Uniprot ID: Q6UXS9
  ENST ID: ENST00000375726
  CDS Start-End: 257-1282
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 114692 - DNA, 1401 bp, Homo sapiens
  Payload ID: 2409
  Gene Symbol: CASP12
  Gene Name: caspase 12 (gene/pseudogene)
  Uniprot ID: Q6UXS9
  ENST ID: ENST00000417998
  CDS Start-End: 257-763
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagcttttctggaaatccagggtgcccaacccagtggcaagttaaagctttgtcctcatgctcacttccatgaactaaagacaaaaagggcagatgagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 114693 - DNA, 1196 bp, Homo sapiens
  Payload ID: 2409
  Gene Symbol: CASP12
  Gene Name: caspase 12 (gene/pseudogene)
  ENST ID: ENST00000446862
  CDS Start-End: 257-1090
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 114694 - DNA, 819 bp, Homo sapiens
  Payload ID: 2409
  Gene Symbol: CASP12
  Gene Name: caspase 12 (gene/pseudogene)
  ENST ID: ENST00000447913
  CDS Start-End: 257-679
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggta

SEQ ID NO: 114695 - DNA, 774 bp, Homo sapiens
  Payload ID: 2409
  Gene Symbol: CASP12
  Gene Name: caspase 12 (gene/pseudogene)
  Uniprot ID: Q6UXS9
  ENST ID: ENST00000508062
  CDS Start-End: 1-774
atggctgatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaa

SEQ ID NO: 114696 - DNA, 1685 bp, Homo sapiens
  Payload ID: 2409
  Gene Symbol: CASP12
  Gene Name: caspase 12 (gene/pseudogene)
  Uniprot ID: Q6UXS9
  ENST ID: ENST00000422698
  CDS Start-End: 257-1279
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatggatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattataaaattgtgcttgttttctaattttgtcataaattaagtcatgcttataggagaaaaaattaagtattaaaaatcataaaaaatgaagaaataatcatcatcaacctttttaaaactattcataaaaactcaagttttttatatagcttatttattttgtatatccaattttgtgtgcttttattatattgttataacattactactagtaataaaactat

SEQ ID NO: 114697 - DNA, 709 bp, Homo sapiens
  Payload ID: 2409
  Gene Symbol: CASP12
  Gene Name: caspase 12 (gene/pseudogene)
  ENST ID: ENST00000433738
  CDS Start-End: 257-685
gtgtacatgatttcattctgttcactttgttatgtcaaaaagaagaaaacaccttctgcttcctattttccaaaggaaagcagttatacacgagatcagagtctaattttatcttggcaaagaaaaagagaatttgaggactgggaattttccattcagggtaatatcaacaagctggtccactgagaggagagcaagcctgttgaaattgtttttgctttcacagctttttcctgtccggggagcaggagaagccatggctgatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcagatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacgttcaacattcatttgagaccccaaatatactgacccagctgcccaccattgaaagactatccatgacacgatatttctatctctttcctgggaattaaaactcataagaagcaactcaggta

SEQ ID NO: 114698 - DNA, 1451 bp, Homo sapiens
  Payload ID: 2409
  Gene Symbol: CASP12
  Gene Name: caspase 12 (gene/pseudogene)
  ENST ID: ENST00000613512
  CDS Start-End: 20-1045
ccggggagcaggagaagccatggctgatgagaaaccatccaacggtgttctggtccacatggtgaagttgctgatcaagacctttctagatggcatttttgatgatttgatggaaaataatgtgttaaatacagatgagatacaccttataggaaaatgtctaaagtttgtggtgagcaatgctgaaaacctggttgatgatatcactgagacagctcaaattgcaggcaaaatatttagggaacacctgtggaattccaaaaaacagctgagttcagatatatccagtgatggagaaagagaggcgaacatgcctggcctcaacatccgcaacaaagaattcaactatcttcataatcgaaatggttctgaacttgaccttttggggatgtgagatctacttgaaaaccttggatactcagtggttataaaagagaatctcacagctcaggaaatggaaacagcactaaggcagtttgctgctcacccagagcaccagtcctcagacagcacattcctggtgtttatgtcacatagcatcctgaatggaatctgtgggaccaagcactgggatcaagagccagatgttcttcacgatgacaccatctttgaaattttcaacaaccgtaactgccagagtctgaaagacaaacccaaggtcatcatcatgcaagcctgccgaggcaatggtgctgggattgtttggttcaccactgacagtggaaaagccagtgcagatactcatggtcggctcttgcaaggtaacatctgtaatgatgctgttacaaaggctcatgtggaaaaggacttcattgctttcaaatcttccacaccacataatgtttcttggagacatgaaacaaatggctctgtcttcatttcccaaattatctactacttcagagagtattcttggagtcatcatctagaggaaatttttcaaaaggttcaacattcatttgagaccccaaatatactgacccagctgcccaccattgaaagactatccatgacacgatatttctatctctttcctgggaattaaaactcataagaagcaactcaggaaaatgaaggcattatggtgtctatgaatctgctattagaaaaggtcaatttttgattaagaatatttttataccaaactgctcagctgtccaccttttcaaataccaggctaaaatcaatctcatatttttgctaaattaatgcttaataaatttttattataaaattgtgcttgttttctaattttgtcataaattaagtcatgcttataggagaaaaaattaagtattaaaaatcataaaaaatgaagaaataatcatcatcaacctttttaaaactattcataaaaactcaagttttttatatagcttatttattttgtatatccaattttgtgtgcttttattatattgttataacattactactagtaataaaactat

SEQ ID NO: 114699 - DNA, 3241 bp, Homo sapiens
  Payload ID: 2410
  Gene Symbol: CASP14
  Gene Name: caspase 14, apoptosis-related cysteine peptidase
  Uniprot ID: P31944
  ENST ID: ENST00000427043
  CDS Start-End: 309-1037
acaccacagctgtgtgccaagggtgtgtcatgaggtttcttgagtgacagaaaactcaccgacaataaagggccaggtgattgtgccacccgattcatagaccaggcttctcaggagaaaccccgggagattccacactgtcagccccttctccaagatcagtacgtgggcctgactcctcctcggtgcccagctcagtattggcaactaggagagtagtgagattgaacttggccttgaggaacagctgcctctagagttggatcagacaagggtgctgagagccgggactcacaaccaaaggagaaatgagcaatccgcggtctttggaagaggagaaatatgatatgtcaggtgcccgcctggccctaatactgtgtgtcaccaaagcccgggaaggttccgaagaagacctggatgctctggaacacatgtttcggcagctgagattcgaaagcaccatgaaaagagaccccactgccgagcaattccaggaagagctggaaaaattccagcaggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcgaggagaacaaagggaccccggtgaaacagtaggtggagatgagattgtgatggtcatcaaagacagcccacaaaccatcccaacatacacagatgccttgcacgtttattccacggtagagggatacatcgcctaccgacatgatcagaaaggctcatgctttatccagaccctggtggatgtgttcacgaagaggaaaggacatatcttggaacttctgacagaggtgacccggcggatggcagaagcagagctggttcaagaaggaaaagcaaggaaaacgaaccctgaaatccaaagcaccctccggaaacggctgtatctgcagtagaagtagaaagaccaggaggagctttccttccagcattctttctgtctcacagaaatttagaggcagctcttacctctccccaagatcttctgttcccaaggccaaatggcacccagtttcttttccatcacacccttcatgcaggtcctcctgtccttattagagcaagccagccaaaacttagcacaaggcatggtggcaacattaacatcacctccctcaggctggactttctatctttattaatgcaaccgaagagacctaagagtgcattcacttatcccactttctgttcctgtggtcttctttctcccatgaagcagaaactggataaagctcaagattttccatagacaaaccaaagcccactcatcccctcctaccccaatccaacctctgctggctcctgcatctcacttggaggtcaaacctcctcctgaggccaatgcattcccaacttccagttctttcctttaccctggagagttagtaaggtaagaaccattctttctctccaaaaccactcctccttggctggcaagttggtgtcctaactccgttctcttcctagctcatggcctctctagataataaagttgtctcctcctttctggatctcttcctcctaacacccctcccctgaaaccctggactctgccctctctccaagaaaatccatctattcaactattcttgcattcaattactctaaatgagagcgtgttggagctatggcaaattccctgttgtcaccttgctattttgcagacaacataatatttaacctctcataaccagagaggttaaataatttgtcaaatgcaatacagtaagacagaggcaaggacaaggtttgacttccagcccagcctcttttccacaacctgctaaatcctgatccatctgaaaacttttctaattagtgaagatgactaataaaaattttccctatctccaaggtaggagctttctggaagtttctagaaattttcaataaccaccagccaaggttacctccaggtaaccttgcagcaccaggctggaagtcagatcggcttcactatcttccaactctacagcctgtatctctccatccccagctttgacctttcctgctcaagtaacctacgggcacatccagcgtcactaaaaactcagggcttttcttcccggttactcctccaagcgttccctggtatcctcaacctcagatcccaggttcagatttctgcagtcaatctatgacccctctcttcttgcatccttcatatgccaccagacaccatgcccagtccagcctgattttgaaacaactttcatgccggtcttctcttccctgacatgttactgtccaggctcaagtcctcagcttctcatatctgcatctttgcaaccaacttcctcccttgcctctctgcttttccatcccacttttcatgtgtcctccataccatctataacagtgatctccctggaacactcaagaagacacaacataccatattatttaaagaccagggtactggacagtggctcacacctgtattcccgactttgagagtctgaagcgggaggatcacttgaggccaggagttaagagaccagcctgggcaacacagcaagaccctgtctctaaaaaaaaaaattaattaactgggtatggtggcacatgcctgtagtcccagctactcaggaggctgaggtgggaggatgacttgagcccaggagtttgaggctgcaaggagctatgatcatgccagtgcatcccagctctaggtgagacagtgagatccggtctccaaaataaatcaatcaatcaaataaagaccaaagtcaaaccgcacatcaggatctctcacacccttccaattttgccatctaccagcacttagctaaacccatctcccatctcttccaccatgaattcactctttcaaaaaggctaatgtcttcttactcacccttgcctctaagcctttgctatcaccatttcccccaagctggagggccctccctctccctttacccctcttccactacctcccacccctactttttccagaaagccatttcctctcttttttctgattgatccttccctctcacccaggattagatgctggaaatgaccacttctggagggcagggaacaagcccttaatctgcataatgagtgttcaataaacagttgtcaaactttgaaa

SEQ ID NO: 114700 - DNA, 4225 bp, Homo sapiens
  Payload ID: 2411
  Gene Symbol: CASP2
  Gene Name: caspase 2, apoptosis-related cysteine peptidase
  Uniprot ID: P42575
  ENST ID: ENST00000310447
  CDS Start-End: 242-1600
cttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattactga

SEQ ID NO: 114701 - DNA, 1146 bp, Homo sapiens
  Payload ID: 2411
  Gene Symbol: CASP2
  Gene Name: caspase 2, apoptosis-related cysteine peptidase
  ENST ID: ENST00000350623
  CDS Start-End: 6-332
gggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatga

SEQ ID NO: 114702 - DNA, 616 bp, Homo sapiens
  Payload ID: 2411
  Gene Symbol: CASP2
  Gene Name: caspase 2, apoptosis-related cysteine peptidase
  ENST ID: ENST00000392925
  CDS Start-End: 62-577
cggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagaaatagggtcttgttctgtcacccaggctggaatgcagtgacaccaccatagctcactgcagcgttgaactcctgggttg

SEQ ID NO: 114703 - DNA, 4006 bp, Homo sapiens
  Payload ID: 2411
  Gene Symbol: CASP2
  Gene Name: caspase 2, apoptosis-related cysteine peptidase
  ENST ID: ENST00000619992
  CDS Start-End: 242-568
cttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattactg

SEQ ID NO: 114704 - DNA, 2673 bp, Homo sapiens
  Payload ID: 2412
  Gene Symbol: CASP3
  Gene Name: caspase 3, apoptosis-related cysteine peptidase
  Uniprot ID: P42574
  ENST ID: ENST00000308394
  CDS Start-End: 264-1097
acatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 114705 - DNA, 2624 bp, Homo sapiens
  Payload ID: 2412
  Gene Symbol: CASP3
  Gene Name: caspase 3, apoptosis-related cysteine peptidase
  ENST ID: ENST00000393585
  CDS Start-End: 336-884
atccgtggccacagctggttggcgtcgccttgaaatcccaggccgtgaggagttagcgagccctgctcacactcggcgctctggttttcggtgggtgtgccctgcacctgcctcttcccccattctcaatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 114706 - DNA, 677 bp, Homo sapiens
  Payload ID: 2412
  Gene Symbol: CASP3
  Gene Name: caspase 3, apoptosis-related cysteine peptidase
  ENST ID: ENST00000393588
  CDS Start-End: 77-625
gcggaagcagtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccg

SEQ ID NO: 114707 - DNA, 549 bp, Homo sapiens
  Payload ID: 2412
  Gene Symbol: CASP3
  Gene Name: caspase 3, apoptosis-related cysteine peptidase
  ENST ID: ENST00000447121
  CDS Start-End: 198-549
agtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcgttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgc

SEQ ID NO: 114708 - DNA, 964 bp, Homo sapiens
  Payload ID: 2412
  Gene Symbol: CASP3
  Gene Name: caspase 3, apoptosis-related cysteine peptidase
  ENST ID: ENST00000517513
  CDS Start-End: 236-784
agtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttgg

SEQ ID NO: 114709 - DNA, 2540 bp, Homo sapiens
  Payload ID: 2412
  Gene Symbol: CASP3
  Gene Name: caspase 3, apoptosis-related cysteine peptidase
  Uniprot ID: P42574
  ENST ID: ENST00000523916
  CDS Start-End: 131-964
aggggcgggcgggaggcggggctggcgctggagcacatctcccggcggcgggccgcggaagcagtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 114710 - DNA, 2621 bp, Homo sapiens
  Payload ID: 2412
  Gene Symbol: CASP3
  Gene Name: caspase 3, apoptosis-related cysteine peptidase
  ENST ID: ENST00000613118
  CDS Start-End: 309-779
atccgtggccacagctggttggcgtcgccttgaaatcccaggccgtgaggagttagcgagccctgctcacactcggcgctctggttttcggtgggtgtgccctgcacctgcctcttcccccattctcaatgagatcaccatcctcagaataatttgtaccccgctgggcactagctaatggaggtgatgtcatgctaagcagcacttcagtgagttttgcgggaaccaaagctctgctcccaggagtgtggatttggtgctttcatgtggaaaaagcggatgatgacaagtagagagcaaatgtgcgcatgtctgatgctttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 114711 - DNA, 1340 bp, Homo sapiens
  Payload ID: 2413
  Gene Symbol: CASP4
  Gene Name: caspase 4, apoptosis-related cysteine peptidase
  Uniprot ID: P49662
  ENST ID: ENST00000393150
  CDS Start-End: 264-1229
cagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacg

SEQ ID NO: 114712 - DNA, 2158 bp, Homo sapiens
  Payload ID: 2413
  Gene Symbol: CASP4
  Gene Name: caspase 4, apoptosis-related cysteine peptidase
  Uniprot ID: P49662
  ENST ID: ENST00000444739
  CDS Start-End: 912-2045
aaatgagagctctgtctgtaaactctaggtggagttgctgaaattcctgcaagcatttcttgccgggagaggagggatggatcccggtcccacctaaagaagcagtctggccatgatctgccacagcggctgtgctgcactgtgaagactgctgcccagtccaatctgcccagcctccctagcactggtagggaaaaaccgctgactagagctgcagtaatggcagtcgcccctcccctggggaactcggtcatctctggcgtactccaggctgctatgctggctagtggggattctaatccagcggatctaagcttgcaggcttctgtgagaatggacctgctgcaaggccattttgctccctggcttcagccccctttccatgggagtggacgggactcctgcctcactagagttccgggagctgctggactatgtaaaaactcctgcagctcagtgcctgcccaaaaagctggaaatatgaactattgggttaattcttatcaggaaatgaaaaagagttgttagattaaacttcttcagtcattgtcgttctttgtaatcagagaaagaaaaactgagagatcaggaagagaagagacagatggatagaagaagtttgggtggccacaggaaacaagaaaagaaacaagctgaggtgtcaacccacaggataatattttgtcattttcatttttttcccccaagtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 114713 - DNA, 763 bp, Homo sapiens
  Payload ID: 2413
  Gene Symbol: CASP4
  Gene Name: caspase 4, apoptosis-related cysteine peptidase
  ENST ID: ENST00000417440
  CDS Start-End: 321-763
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgacca

SEQ ID NO: 114714 - DNA, 215 bp, Homo sapiens
  Payload ID: 2413
  Gene Symbol: CASP4
  Gene Name: caspase 4, apoptosis-related cysteine peptidase
  ENST ID: ENST00000533252
  CDS Start-End: 1-215
acaacgtgtcctggagagacagcacaatgggctctatcttcatcacacaactcatcacatgcttccagaaatattcttggtgctgccacctagaggaagtatttcggaaggaagccacaagcagcccagccctccttaatcaacttcaaggagcaccttcattagtacagcttgcatatttaacattttgtatttcaataaaagtgaagacaaac

SEQ ID NO: 114715 - DNA, 1338 bp, Homo sapiens
  Payload ID: 2413
  Gene Symbol: CASP4
  Gene Name: caspase 4, apoptosis-related cysteine peptidase
  ENST ID: ENST00000613196
  CDS Start-End: 235-1227
cagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacg

SEQ ID NO: 114716 - DNA, 1414 bp, Homo sapiens
  Payload ID: 2414
  Gene Symbol: CASP5
  Gene Name: caspase 5, apoptosis-related cysteine peptidase
  Uniprot ID: P51878
  ENST ID: ENST00000260315
  CDS Start-End: 1-1305
atggctgaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgta

SEQ ID NO: 114717 - DNA, 1488 bp, Homo sapiens
  Payload ID: 2414
  Gene Symbol: CASP5
  Gene Name: caspase 5, apoptosis-related cysteine peptidase
  Uniprot ID: P51878
  ENST ID: ENST00000393141
  CDS Start-End: 33-1376
agtgctgtacaaagagacagaggctgttagctatggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 114718 - DNA, 1237 bp, Homo sapiens
  Payload ID: 2414
  Gene Symbol: CASP5
  Gene Name: caspase 5, apoptosis-related cysteine peptidase
  Uniprot ID: P51878
  ENST ID: ENST00000444749
  CDS Start-End: 32-1162
gtgctgtacaaagagacagaggctgttagctatggctgaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtc

SEQ ID NO: 114719 - DNA, 535 bp, Homo sapiens
  Payload ID: 2414
  Gene Symbol: CASP5
  Gene Name: caspase 5, apoptosis-related cysteine peptidase
  ENST ID: ENST00000438448
  CDS Start-End: 1-353
aaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatttcagctaaagatggggtccttgtcacacgaccatgagaaattagactcacagacaatctgaaaggaaaccacaggcagcccagccctcctctgtcaacatcaaagagcacatttaccagtatagcttgcatagtcaatatttggtatttcaataaaagtaaagactgtatcttttta

SEQ ID NO: 114720 - DNA, 1023 bp, Homo sapiens
  Payload ID: 2414
  Gene Symbol: CASP5
  Gene Name: caspase 5, apoptosis-related cysteine peptidase
  Uniprot ID: P51878
  ENST ID: ENST00000418434
  CDS Start-End: 33-911
agtgctgtacaaagagacagaggctgttagctatggctgctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 114721 - DNA, 979 bp, Homo sapiens
  Payload ID: 2414
  Gene Symbol: CASP5
  Gene Name: caspase 5, apoptosis-related cysteine peptidase
  Uniprot ID: P51878
  ENST ID: ENST00000456200
  CDS Start-End: 1-327
atggctgaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacga

SEQ ID NO: 114722 - DNA, 623 bp, Homo sapiens
  Payload ID: 2414
  Gene Symbol: CASP5
  Gene Name: caspase 5, apoptosis-related cysteine peptidase
  ENST ID: ENST00000456094
  CDS Start-End: 129-623
gttagctatggctgagctttgtctaaagcaagggcaaaactctttaagctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgag

SEQ ID NO: 114723 - DNA, 879 bp, Homo sapiens
  Payload ID: 2414
  Gene Symbol: CASP5
  Gene Name: caspase 5, apoptosis-related cysteine peptidase
  Uniprot ID: P51878
  ENST ID: ENST00000531367
  CDS Start-End: 1-879
atggctgctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattga

SEQ ID NO: 114724 - DNA, 1344 bp, Homo sapiens
  Payload ID: 2414
  Gene Symbol: CASP5
  Gene Name: caspase 5, apoptosis-related cysteine peptidase
  Uniprot ID: P51878
  ENST ID: ENST00000526056
  CDS Start-End: 1-1344
atggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattga

SEQ ID NO: 114725 - DNA, 1548 bp, Homo sapiens
  Payload ID: 2415
  Gene Symbol: CASP6
  Gene Name: caspase 6, apoptosis-related cysteine peptidase
  Uniprot ID: P55212
  ENST ID: ENST00000265164
  CDS Start-End: 79-960
ccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatct

SEQ ID NO: 114726 - DNA, 1347 bp, Homo sapiens
  Payload ID: 2415
  Gene Symbol: CASP6
  Gene Name: caspase 6, apoptosis-related cysteine peptidase
  Uniprot ID: P55212
  ENST ID: ENST00000352981
  CDS Start-End: 25-639
tgtctggctgcgcgtttggctgcaatgagctcggcctcggggctccgcagggggcacccggcagtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcgaaattcatatttt

SEQ ID NO: 114727 - DNA, 538 bp, Homo sapiens
  Payload ID: 2415
  Gene Symbol: CASP6
  Gene Name: caspase 6, apoptosis-related cysteine peptidase
  ENST ID: ENST00000505486
  CDS Start-End: 189-431
agctttaactctgggaaggaccagcccgatccacgggagcccgggcggcgcgcaatcagaaccaactggccccacgctcgggggcagggggcggggccgccgaggaagggccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcagtgtcaactgttagccacgcagatgccgattgctttgtgtgtgtcttcctgagccatggcgaaggcaatcacatttatgcatatgatgctaaaatcgaaattcagacattaactggcttgt

SEQ ID NO: 114728 - DNA, 587 bp, Homo sapiens
  Payload ID: 2415
  Gene Symbol: CASP6
  Gene Name: caspase 6, apoptosis-related cysteine peptidase
  ENST ID: ENST00000503684
  CDS Start-End: 158-587
gggcttcagctggaggcggccagttcctggcggccagcacaccccggtatctctcttcttcatccaggaaacctgctgctgtctgtcggtttgagccaaaaccacaataacttttttctgcaaagtaatcaactgctaagagcgtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcagg

SEQ ID NO: 114729 - DNA, 2659 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000345633
  CDS Start-End: 385-1296
cccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 114730 - DNA, 2421 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000369315
  CDS Start-End: 147-1058
gactgtgccagtcccagccgccctaccgccgtgggaacgatgctgtaatggactgtgttggttggcctccaggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 114731 - DNA, 2377 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000369318
  CDS Start-End: 103-1014
gagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 114732 - DNA, 2620 bp, Homo sapiens
  Payload ID: 2416
  Gene Symbol: CASP7
  Gene Name: caspase 7, apoptosis-related cysteine peptidase
  ENST ID: ENST00000369321
  CDS Start-End: 87-1253
cccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagcccctgactctggaactttatatttcaccagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaacc

SEQ ID NO: 114733 - DNA, 2380 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000369331
  CDS Start-End: 147-908
gcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatatggaatcttgctctgtcacccaggctggagtgcagcggcgtgatctcggaagactgcaacctccacctcccaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgctt

SEQ ID NO: 114734 - DNA, 2271 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000452490
  CDS Start-End: 68-904
gagtttttattattacagagaagaaggaaactcacttcctgtcgtcgcagagcacagcctagttctgatgcagaggggactgttttcagatggagacactagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaacc

SEQ ID NO: 114735 - DNA, 834 bp, Homo sapiens
  Payload ID: 2416
  Gene Symbol: CASP7
  Gene Name: caspase 7, apoptosis-related cysteine peptidase
  ENST ID: ENST00000429617
  CDS Start-End: 168-834
ccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcct

SEQ ID NO: 114736 - DNA, 2555 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000614447
  CDS Start-End: 311-1072
cccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatatggaatcttgctctgtcacccaggctggagtgcagcggcgtgatctcggaagactgcaacctccacctcccaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaacc

SEQ ID NO: 114737 - DNA, 2378 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000621607
  CDS Start-End: 1-1011
atggactgtgttggttggcctccaggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaacc

SEQ ID NO: 114738 - DNA, 2467 bp, Homo sapiens
  Payload ID: 2416
  Gene Symbol: CASP7
  Gene Name: caspase 7, apoptosis-related cysteine peptidase
  Uniprot ID: P55210
  ENST ID: ENST00000621345
  CDS Start-End: 189-1100
aacaaatatttcccgaaagatccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaacc

SEQ ID NO: 114739 - DNA, 6151 bp, Homo sapiens
  Payload ID: 2417
  Gene Symbol: CASP8AP2
  Gene Name: caspase 8 associated protein 2
  ENST ID: ENST00000551025
  CDS Start-End: 236-6151
aaaggaaccgggttgtcttgggccgggcagggcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtaactacccaatttttacatctc

SEQ ID NO: 114740 - DNA, 1153 bp, Homo sapiens
  Payload ID: 2417
  Gene Symbol: CASP8AP2
  Gene Name: caspase 8 associated protein 2
  ENST ID: ENST00000552401
  CDS Start-End: 70-1153
gggcagaaaggaaccgggttgtcttgggccgggcagggcgggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaag

SEQ ID NO: 114741 - DNA, 1280 bp, Homo sapiens
  Payload ID: 2417
  Gene Symbol: CASP8AP2
  Gene Name: caspase 8 associated protein 2
  ENST ID: ENST00000419040
  CDS Start-End: 197-1280
aaaggaaccgggttgtcttgggccgggcagggcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaag

SEQ ID NO: 114742 - DNA, 2540 bp, Homo sapiens
  Payload ID: 2418
  Gene Symbol: CASP8
  Gene Name: caspase 8, apoptosis-related cysteine peptidase
  Uniprot ID: Q14790
  ENST ID: ENST00000264274
  CDS Start-End: 236-1423
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 114743 - DNA, 1906 bp, Homo sapiens
  Payload ID: 2418
  Gene Symbol: CASP8
  Gene Name: caspase 8, apoptosis-related cysteine peptidase
  Uniprot ID: Q14790
  ENST ID: ENST00000264275
  CDS Start-End: 281-1771
tttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggttccacttctgccgcatgagctgggctgaagcaaacagccagtgccagacacagtctgtacctttctggcggagggtcgatcatctattaataagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgc

SEQ ID NO: 114744 - DNA, 2650 bp, Homo sapiens
  Payload ID: 2418
  Gene Symbol: CASP8
  Gene Name: caspase 8, apoptosis-related cysteine peptidase
  Uniprot ID: Q14790
  ENST ID: ENST00000323492
  CDS Start-End: 141-1535
gtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 114745 - DNA, 2930 bp, Homo sapiens
  Payload ID: 2418
  Gene Symbol: CASP8
  Gene Name: caspase 8, apoptosis-related cysteine peptidase
  Uniprot ID: Q14790
  ENST ID: ENST00000358485
  CDS Start-End: 197-1813
agtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 114746 - DNA, 1060 bp, Homo sapiens
  Payload ID: 2418
  Gene Symbol: CASP8
  Gene Name: caspase 8, apoptosis-related cysteine peptidase
  Uniprot ID: Q14790
  ENST ID: ENST00000392258
  CDS Start-End: 241-948
agactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatgactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgagaatgtttttagctggtggcaataaatattagaagcctgcagaatccagctacgaatatagagggttttgctcttg

SEQ ID NO: 114747 - DNA, 1630 bp, Homo sapiens
  Payload ID: 2418
  Gene Symbol: CASP8
  Gene Name: caspase 8, apoptosis-related cysteine peptidase
  Uniprot ID: Q14790
  ENST ID: ENST00000392263
  CDS Start-End: 236-1630
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattga

SEQ ID NO: 114748 - DNA, 1283 bp, Homo sapiens
  Payload ID: 2418
  Gene Symbol: CASP8
  Gene Name: caspase 8, apoptosis-related cysteine peptidase
  ENST ID: ENST00000392266
  CDS Start-End: 91-927
gaagttttctctttctctcggagaccagattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctatt

SEQ ID NO: 114749 - DNA, 707 bp, Homo sapiens
  Payload ID: 2418
  Gene Symbol: CASP8
  Gene Name: caspase 8, apoptosis-related cysteine peptidase
  ENST ID: ENST00000447616
  CDS Start-End: 80-707
atggttggaaattgggcatctgttcctttaaacaggaaacatttcttgttcgaattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagactttggacaaagtttaccaaatgaaaagcaaacctcggggatactgtctgatcatcaacaatcacaattttgcaaaa

SEQ ID NO: 114750 - DNA, 308 bp, Homo sapiens
  Payload ID: 2418
  Gene Symbol: CASP8
  Gene Name: caspase 8, apoptosis-related cysteine peptidase
  ENST ID: ENST00000424461
  CDS Start-End: 1-252
aacctgctggatattttcatagagatggagaagagggtcatcctgggagaaggaaagttggacatcctgaaaagagtctgtgcccaaatcaacaagagcctgctgaagataatcaacgactatgaagaattcagcaaagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgagaatgtttttagctggtggc

SEQ ID NO: 114751 - DNA, 717 bp, Homo sapiens
  Payload ID: 2418
  Gene Symbol: CASP8
  Gene Name: caspase 8, apoptosis-related cysteine peptidase
  ENST ID: ENST00000429881
  CDS Start-End: 369-717
agattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaat

SEQ ID NO: 114752 - DNA, 686 bp, Homo sapiens
  Payload ID: 2418
  Gene Symbol: CASP8
  Gene Name: caspase 8, apoptosis-related cysteine peptidase
  ENST ID: ENST00000450491
  CDS Start-End: 239-686
ggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcag

SEQ ID NO: 114753 - DNA, 1275 bp, Homo sapiens
  Payload ID: 2418
  Gene Symbol: CASP8
  Gene Name: caspase 8, apoptosis-related cysteine peptidase
  ENST ID: ENST00000444430
  CDS Start-End: 1-777
aacctgctggatattttcatagagatggagaagagggtcatcctgggagaaggaaagttggacatcctgaaaagagtctgtgcccaaatcaacaagagcctgctgaagataatcaacgactatgaagaattcagcaaaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggc

SEQ ID NO: 114754 - DNA, 592 bp, Homo sapiens
  Payload ID: 2418
  Gene Symbol: CASP8
  Gene Name: caspase 8, apoptosis-related cysteine peptidase
  ENST ID: ENST00000440732
  CDS Start-End: 219-592
gttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgca

SEQ ID NO: 114755 - DNA, 658 bp, Homo sapiens
  Payload ID: 2418
  Gene Symbol: CASP8
  Gene Name: caspase 8, apoptosis-related cysteine peptidase
  ENST ID: ENST00000413726
  CDS Start-End: 64-658
gattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatg

SEQ ID NO: 114756 - DNA, 777 bp, Homo sapiens
  Payload ID: 2418
  Gene Symbol: CASP8
  Gene Name: caspase 8, apoptosis-related cysteine peptidase
  ENST ID: ENST00000437283
  CDS Start-End: 115-291
gattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcggatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcct

SEQ ID NO: 114757 - DNA, 1629 bp, Homo sapiens
  Payload ID: 2418
  Gene Symbol: CASP8
  Gene Name: caspase 8, apoptosis-related cysteine peptidase
  Uniprot ID: Q14790
  ENST ID: ENST00000432109
  CDS Start-End: 190-1629
ctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattga

SEQ ID NO: 114758 - DNA, 1621 bp, Homo sapiens
  Payload ID: 2419
  Gene Symbol: CASP9
  Gene Name: caspase 9, apoptosis-related cysteine peptidase
  Uniprot ID: P55211
  ENST ID: ENST00000348549
  CDS Start-End: 148-948
gtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcgagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 114759 - DNA, 2019 bp, Homo sapiens
  Payload ID: 2419
  Gene Symbol: CASP9
  Gene Name: caspase 9, apoptosis-related cysteine peptidase
  Uniprot ID: P55211
  ENST ID: ENST00000333868
  CDS Start-End: 96-1346
ggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 114760 - DNA, 1351 bp, Homo sapiens
  Payload ID: 2419
  Gene Symbol: CASP9
  Gene Name: caspase 9, apoptosis-related cysteine peptidase
  Uniprot ID: P55211
  ENST ID: ENST00000375890
  CDS Start-End: 262-1263
aattgaccctggggacagggcgaggcgcggaggcgtcctgaaggcgaggcggtgacgcaagagcgaatccttggggcggggcgaggcgttggagatgcgtcctgcgggcgggacggtaacgcgggggcggggcggtgacgtgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgca

SEQ ID NO: 114761 - DNA, 1878 bp, Homo sapiens
  Payload ID: 2419
  Gene Symbol: CASP9
  Gene Name: caspase 9, apoptosis-related cysteine peptidase
  ENST ID: ENST00000400777
  CDS Start-End: 1-457
agcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttgactgtcctctagggagcgtggggagagcccgggtttacgtgggtccctgtgctggcaggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagct

SEQ ID NO: 114762 - DNA, 954 bp, Homo sapiens
  Payload ID: 2419
  Gene Symbol: CASP9
  Gene Name: caspase 9, apoptosis-related cysteine peptidase
  ENST ID: ENST00000447522
  CDS Start-End: 156-954
gcgcggaatggattctggggtcggcgcgaggcgctgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccag

SEQ ID NO: 114763 - DNA, 740 bp, Homo sapiens
  Payload ID: 2419
  Gene Symbol: CASP9
  Gene Name: caspase 9, apoptosis-related cysteine peptidase
  ENST ID: ENST00000424908
  CDS Start-End: 1-595
ctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtgggggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacag

SEQ ID NO: 114764 - DNA, 781 bp, Homo sapiens
  Payload ID: 2419
  Gene Symbol: CASP9
  Gene Name: caspase 9, apoptosis-related cysteine peptidase
  ENST ID: ENST00000440484
  CDS Start-End: 18-781
ttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaaggccagccacctgcagttcccaggggctgtctacggcacagatggatgccctgtgtcggtcgagaagattgtgaacatcttcaatgggaccagctgccccagcctgggagggaagcccaagctctttttcatcca

SEQ ID NO: 114765 - DNA, 1111 bp, Homo sapiens
  Payload ID: 2419
  Gene Symbol: CASP9
  Gene Name: caspase 9, apoptosis-related cysteine peptidase
  ENST ID: ENST00000474305
  CDS Start-End: 1-288
atggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataa

SEQ ID NO: 114766 - DNA, 4463 bp, Homo sapiens
  Payload ID: 2419
  Gene Symbol: CASP9
  Gene Name: caspase 9, apoptosis-related cysteine peptidase
  ENST ID: ENST00000546424
  CDS Start-End: 246-1511
ttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtgagtgctgccttcctctgcaaaggagaggggaggctgctgaggggcagcgtgtcctcctggggctggggatttggggtgagcagggcaggcccaaaccaagggtaaaaggtagtagactcctgcctctgagccttggagtcggcacttttgtgtctctttatgagaggcatcctgcctgtggtgacgtttgccctttattcaaagagttgccttccctgtctcctccaaggtccccaggttgacacctcccgctcctccactgatggagctggtcctcagtgccagcgcaggatggctctgtccagaccctgaaggcgggtcatgggcccctccctatatcctgtgggcatcatgtagtcttctactcttgaccctcaagaattgtgaacccctccttgtacatcgccttctcaggaggccccagtgaggaaacagatagggaagggtggcctgataggcccagtcctactccatagaaacccgactcagagcagttgcttcctctgagggtcctgtggccttgtggctgccttgggaggcagcatgtatgggccccagctgctctgctcaggtattcatgccacgagaaggggctgcgaggctggggccactcctggctccttgcaaatatttcagtctgatttgaactttatgaatttggaaattttgaattttgagttttttaaaggtaaagttgaggtgcgtattctttaagccctcctgctcaaagaggctgcagtttgagctgtttttaaggtgcgggttgagtggacattccccccagcccctcttgaattcttccttcagtccagagaactgaactcacagagctctccatggtcatgtcttacaggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtccaagggaaaacgattatccagagaagagacctggccagaacctgggtcccctgagtcctagccatgcttcccatgtgccttacttgctgaagcacccccggactgcagtgtgaacgtgctgtgcaatagtgacacgctgggcttccccacaaggctccaccctgaggtcttttaagctgtccttatgccagcctatttcttgttttttgggcctttttttttggagatagggtctcactctgtcgcccaggctggagtgcaatgacgcaatcttggcttattgcagtctcgacctcctgggctcaagagatccttccacctcagccacctgagtagcttggactacaggtgtgcaccacctctcccagttaatttttgtatttttagtagagacagagttatgccatgttactcaggctggtcttgaactcctggactcaagcgatcagcctgccttagcctcccaaagtgcaggggttacaggcttgagccattgcgcctgacctatttctggttcttagggccctggatgttaggatggatttctgaattaataataataataaaaccctcatcaagatgtgatttgcatagttgtcactttatataatattattttccttctgtgacctttccaagtctgaaacagtcccagggacttcttttggttagttatttgcaatcacctgcaggacacacacacaagaaaattgtcaggttcacgtaaccacagagctgtgcgtggcagtttcctgtctctgtcctcctgggctaagctactcaagtgagtcacaggcagcccacactacagtagctcctgcctgaggagttcagatgatgtttcggagaaaaagatgcaatcacagcttttcattgacctgttagggtcttcctgtaaagggggtcttagccaggagtcctgtgtgggcttcaggtcagggggccttcgaaccccctaaaaattatatgccaaatgtgcggatggcatatttttagatttcatttgtttctcatcaaaactgctgtttgcaaggcagttatgcactgtggttggggctataactgtttccagaggctgttgatcagtatctgttaaactttttttttttttttttgagacagtcttgctctgttgcccagacgagtaca

SEQ ID NO: 114767 - DNA, 725 bp, Homo sapiens
  Payload ID: 2419
  Gene Symbol: CASP9
  Gene Name: caspase 9, apoptosis-related cysteine peptidase
  ENST ID: ENST00000469637
  CDS Start-End: 583-725
agcaacagttgctaggatggggacgcactctctggtccctattctctttaaccctattcgtagaaccttagagcgtcagattggaagtgaccttagggattctttaactctccaactcctgcaatattgatagggagaccgaggtccagagaggggcagagatttgcccaaggcctagaatccagcattccttttatttttgtttacttatcttttttttttttgagagaatccaggacttttaatcccgtttaccgaaaaccgagctccacccaagaatgtaccagtctgtgccttaagcacggggaaagggcggtgggggtggagagagggataaggcacagggtcttgctctgtcacccaggctgaagtgcagtggtgctatcacagctcactgcagccttatctcctgggctcgagccatcctcttgggagcctcagcctcctgagtagctgggactacagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacat

SEQ ID NO: 114768 - DNA, 2791 bp, Homo sapiens
  Payload ID: 2420
  Gene Symbol: CAAP1
  Gene Name: caspase activity and apoptosis inhibitor 1
  Uniprot ID: Q9H8G2
  ENST ID: ENST00000333916
  CDS Start-End: 90-1175
ccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaaggcaatttttaactatgtagaactaattgcccatgtttaattatagcagacacgccattctaacaggtatttgataccattggatgcattattctaggttttttctttaataaaaatggaacaagttttcatttacattccaagctgtcaggaaatgaagaatattttattatctaggattttatctgatgtagttgcttaaagatctgatgtgctataattccatgaatcagaaataataaaatgctatcattctggatctgaagacttttgatactttttcaaaagcaaaattaatttcaggaacctttgataagttgttgttataattaatctaattttgtatagtttttgtaaataaattaccatccttccacaattagggatgcttttatccccccatcactaattgcagttgtttgataccaaaataaatttacgtagagatccttaacttaaaataaattaattttttcaaaaaacataaatctggaactgttgtttctatatttgataacaaatacagtatattttatttataagccatggtctactgatactgtatgaggactttccttatatataaaagttgcagggattgtgttttattagctgctttaattatgttaattttagagagtttttaaatggaaatagaggacatttatgaaacgctggaattgcagttacaaattctttttgttgttgttgttcctgaacatgccttggaataattctaccattttttccccctccataaatctttctaataaagcatagaaaaagcctatatgattttaaatgcttctcttaagctggtaaacagatttgagttatgagttcattgttattgcttcaagatgaaaagacagtgatataatttttctatttcaacttaaaagtaatagttaatatgctaaagtagtacagaataaactttattgctgcttactaactacaaaatactgtagatggcatctgtatgattaaacatataaagtaaaacaggtctgagggctttgtagatgattaaagtctccaccttcatgaa

SEQ ID NO: 114769 - DNA, 1236 bp, Homo sapiens
  Payload ID: 2420
  Gene Symbol: CAAP1
  Gene Name: caspase activity and apoptosis inhibitor 1
  ENST ID: ENST00000483493
  CDS Start-End: 73-474
cggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggtgcgtgcgcgcccctctggccgcttcctggagctgctgctttttcggaagaagtcgggcttccagagggatggggcgcaggctggagctcactgctagcgcggcaatctcaaggtcgtccgtccttgaggttcatgttcctacctaagtcctggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgaggtttctttcatttataaggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaacct

SEQ ID NO: 114770 - DNA, 773 bp, Homo sapiens
  Payload ID: 2420
  Gene Symbol: CAAP1
  Gene Name: caspase activity and apoptosis inhibitor 1
  ENST ID: ENST00000520187
  CDS Start-End: 89-424
cagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggggctgcgggagcgtcagctgctgtgggaacgccaattttagtggaagtgtcaccggcggtgggagcggcggcagctgttggggcgggagcagcgtggagcgcagcgagcgccggaagcggaggagtaccgactcttccagcgtctcgggctccttgcagcaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttg

SEQ ID NO: 114771 - DNA, 1532 bp, Homo sapiens
  Payload ID: 2420
  Gene Symbol: CAAP1
  Gene Name: caspase activity and apoptosis inhibitor 1
  Uniprot ID: Q9H8G2
  ENST ID: ENST00000625311
  CDS Start-End: 317-967
tcttccagcgtctcgggctccttgcagcaggtgcgtgcgcgcccctctggccgcttcctggagctgctgctttttcggaagaagtcgggcttccagagggatggggcgcaggctggagctcactgctagcgcggcaatctcaaggtcgtccgtccttgaggttcatgttcctacctaagtcctggaaactaaatatattttgccaactttggaaaaagaattattcttggcagagcacagtgaccttgaagaaggtggactggacctgactgtgtcattgaaaccagttagtttctatatatcagacaaaaaagaaatgcttcagcagtgcttctgtattataggagagaaaaagttacagaagatgcttcctgatgtgttaaagaactgttcaatagaagaaattaaaaaactatgccaggaacagttagagctcctgtctgaaaaaaaaattttgaagattcttgagggtgacaatggaatggactctgatatggaagaggaagcagatgatggttctaagatgggatctgatttagtcagtcagcaagacatctgtatagattctgcttcatccgtgagagagaataagcaacctgaaggtttggaattaaaacaaggaaaaggggaagatagtgatgtactcagtataaatgcagatgcttatgacagcgacatagaaggcccatgcaacgaagaagcagctgctcccgaggcaccagaaaatacagtccaaagtgaagctggtcagatagatgacctggagaaagacattgagaaaagtgtgaatgagattctaggactggcagagtctagcccaaacgaacccaaagcagccaccctggctgttcctccaccagaagatgttcaaccttctgcacagcaactggagctgctagaacttgagatgagggcaagagcgattaaagccctaatgaaagctggtgatataaaaaagccagcctaggtatttaacttgattttgaattttaggtatgtttgaacaaagccacatcatttaattttgtatctaaaatttatttggggtcttatatgttatttctcatgtaacccttattaggactcattttagccctaaattacctgtggctgtttctttttatttttttgactacttttatattataaatgtgtgttactgtcttatgaattcatggcaatatagttggatagcctggatactttgttagatgagtatttagctgtgtctgcaaatcttaaaagccattagcaaagagtcgtggtatttttttctttatttttaaatgtttgggcaccaaacctaaaagcaaaagattgacgaagcatgtttctcttaaggctacttgtattttacaatacaatattaaattatttaatttgagaaatttagttttgcttatatgcactttttaaatatatactattttgaagattccttatgtaaatgcaaatttcctagttaaaaccgaataacagagatctgaaatgactgagaaaaacttttttattaaaggaaggaattaatttaa

SEQ ID NO: 114772 - DNA, 3934 bp, Homo sapiens
  Payload ID: 2421
  Gene Symbol: CARD10
  Gene Name: caspase recruitment domain family, member 10
  Uniprot ID: Q9BWT7
  ENST ID: ENST00000251973
  CDS Start-End: 41-3139
ccccgtgcgcctcttgcccgcagaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcata

SEQ ID NO: 114773 - DNA, 4113 bp, Homo sapiens
  Payload ID: 2421
  Gene Symbol: CARD10
  Gene Name: caspase recruitment domain family, member 10
  Uniprot ID: Q9BWT7
  ENST ID: ENST00000403299
  CDS Start-End: 218-3316
ggcgtgcagacggacgcgcggggtggccgggggccggacgcacgacccggggcgggcggcaatgtggggaggcccgggcagcccaggaggctgcggggacgggggcggagccgggggcgccacgggcaccgcccccctgcgccggcggagccgccgcccgagtgcggacccgggagcccgaggcgactgtagcgtgcgggaccctgaggacacggccatgccgggccgggcggaggcgggggaggccgaggaggaggccggggccggctcggggtctgaggcggaggaggacgcgctgtgggagcgaatcgagggcgtccggcatcggctggctcgcgccctgaacccggccaagctcacgccgtatctgcgccagtgccgggtcatcgacgagcaggacgaggaggaggtgctgagcacctaccgcttcccgtgccgcgtcaaccgcaccgggcgcctgatggacatcttgcgctgccgtggcaagaggggctatgaggccttcctggaagccctggagttctactaccccgaacacttcacgctgctcacgggccaggaacccgcccagcgctgctccatgatcctcgatgaggaggggcctgagggcctgacccaattcttgatgacagaggtgcgacggctgcgggaagctcgcaagagccagctgcagcgggagcagcaactgcaggcccggggccgggtgctcgaggaggagcgggcagggctggagcagcggctgcgggaccagcagcaggctcaggagcgctgtcaacggctgcgggaggactgggaggcgggcagcctggagctgctgcggctcaaggatgagaactacatgatcgccatgcgcctggcacagctcagtgaggagaagaactcggctgtacttcgcagccgtgacctgcagctggcggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcataga

SEQ ID NO: 114774 - DNA, 3127 bp, Homo sapiens
  Payload ID: 2421
  Gene Symbol: CARD10
  Gene Name: caspase recruitment domain family, member 10
  Uniprot ID: Q9BWT7
  ENST ID: ENST00000406271
  CDS Start-End: 92-2332
gcacttggctggggtgtgggtctgggggcaagatcttgggcccagggtctacctgtatgggccaggctcagccccttgaagacccctagtcatgggggtgggagtaggtcttgggaatggcctccgtctgctgccctggatggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggagctgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcata

SEQ ID NO: 114775 - DNA, 578 bp, Homo sapiens
  Payload ID: 2421
  Gene Symbol: CARD10
  Gene Name: caspase recruitment domain family, member 10
  ENST ID: ENST00000433485
  CDS Start-End: 1-578
acttccctttattgccctcagatggctggagctctggaaacccaggtcctatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatcc

SEQ ID NO: 114776 - DNA, 2140 bp, Homo sapiens
  Payload ID: 2421
  Gene Symbol: CARD10
  Gene Name: caspase recruitment domain family, member 10
  ENST ID: ENST00000437756
  CDS Start-End: 700-2140
agtgcactcatagtccagcaaactggccatgcacgtctgctcccagcttggtggtcacaccacagctgcccaccccccataccaggccaacttctggctgcacactccgaactggtgattggttaggggcatgggattttgtttgaagctgtgaagacagccacggtcacactgtggcagctctgtagcccttcatagtttagaggcctctgcccacttgctgtcttgtttgattcttgcaacacctttgggaggcaaatgatggggccaggggattgactgggcccattttactgatgaggaaactgaggcccagaggaggtggatcagctcaagctcaaagtgagtcggctggaggaagagtgtgcactgcttcgaagggccaggggcccgccccctggggcagaggagaaggagaaggagaaggagaaggagaaggagccagacaatgtggaccttgtctctgagctgcgtgctgagaaccagcggctgacggcgtcactgcgggagttgcaggagggcctgcagcaggaggcgagccggccgggggccccgggctccgagcgcatcctgctggacatcctagagcatgactggcgggaggcgcaggacagcaggcaggagctgtgccagaagctgcatgccgtgcagggggagctgcagtgggccgaggagctgcgcgaccagtacctgcaggagatggaagacctgcggctcaagcaccgcacgctgcagaaggactgtgacctgtacaagcaccgcatggccactgtcctggcccaactggaggagattgagaaggagcgagaccaggccatccagagccgtgaccggatccagttgcagtactcacagagcctcatcgagaaggaccagtaccgcaagcaggtgcggggcctggaggcggagcgggatgagctgctgacaacgctcaccagcctggagggcaccaaggctctgctggaggttcagctgcagcgggcccagggtggcacctgcctcaaggcctgtgcctcctcccattccctgtgctccaacctcagcagcacttggagcctgagcgagttcccctcccctctgggaggcccagaagcaactggggaggcagctgtcatggggggacctgagcctcacaactcggaggaagccacagacagtgaaaaggagatcaatcggctctccatcctgcccttcccccccagtgccggctccatcctccgccggcagcgtgaggaagaccccgcaccccctaagagatccttcagcagcatgtcagacatcacagggagtgtgacacttaagccctggtcccctggcctctcttcgtcctcatcctctgacagcgtgtggcctttgggaaagccggaaggcctcctggctcggggctgtggcctggacttcctcaacaggtctctggctattcgggtgtctggccggagccccccagggggcccagagccgcaggacaagggaccagatggactgtcgttttatggggacagatggtctggggctgtggtgcgcagggtgctgtctgggcctgggtccgccaggatggaaccaagagagcaaagggtggaagctgctggtctggagggggcgtgcctggaagccgaggcccagcagagaaccttgctctggaatcaggggtccacactcccctccctgatggactcgaaggcctgccagtccttccacgaggccctagaagcctgggcaaagggaccaggtgccgagcccttctacattcgtgccaacctcaccttgcctgagagggcagatccccatgccctttgcgtgaaagcccaagagatccttcgactggtggactcggcatacaagcggaggcaggaatggttctgcacccgggttgaccccctcactctgcgggacctggaccggggcaccgtgcccaattatcagagagcccagcagctcctagaagttcaggagaaatgcctgccctccagccggcaccgaggcccccgcagtaatctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgc

SEQ ID NO: 114777 - DNA, 815 bp, Homo sapiens
  Payload ID: 2422
  Gene Symbol: CARD11
  Gene Name: caspase recruitment domain family, member 11
  ENST ID: ENST00000355508
  CDS Start-End: 1-815
gaagaaggcacggacgccagccctagctcctgcggatctctgcccatcaccaactccttcaccaagatgcccccccggagccgcagcagcatcatgtcaatcaccgccgagcccccgggaaacgactccatcgtcagacgctacaaggaggacgcgccccatcgcagcacagtcgaagaagacaatgacagcggcgggtttgacgccttagatctggatgatgacagtcacgaacgctactccttcggaccctcctccatccactcctcctcctcctcccaccaatccgagggcctggatgcctacgacctggagcaggtcaacctcatgttcaggaagttctctctggaaagacccttccggccttcggtcacctctgtggggcacgtgcggggcccagggccctcggtgcagcacacgacgctgaatggcgacagcctcacctcccagctcaccctgctggggggcaacgcgcgagggagcttcgtgcactcggtcaagcctggctctctggccgagaaagccggcctccgtgagggccaccagctgctgctgctagaaggctgcatccgaggcgagaggcagagtgtcccgttggacacatgcaccaaagaggaagcccactggaccatccagaggtgcagcggccccgtcacgctgcactacaaggtcaaccacgaagggtaccggaagctggtgaaggacatggaggacggcctgatcacatcgggggactcgttctacatccggctgaacctgaacatctccagccagctggacgcctgcaccatgtccctgaagtgtgacgatgttgt

SEQ ID NO: 114778 - DNA, 584 bp, Homo sapiens
  Payload ID: 2422
  Gene Symbol: CARD11
  Gene Name: caspase recruitment domain family, member 11
  ENST ID: ENST00000356408
  CDS Start-End: 366-584
gactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccaggaggagagagaatttgagaggaacacgaggaacccccaggacccagctggctcacaaccgcatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagca

SEQ ID NO: 114779 - DNA, 4366 bp, Homo sapiens
  Payload ID: 2422
  Gene Symbol: CARD11
  Gene Name: caspase recruitment domain family, member 11
  Uniprot ID: Q9BXL7
  ENST ID: ENST00000396946
  CDS Start-End: 405-3869
agtctcatttcctgtcgggttttgcatttccctcccccgcccctcccagcctatgacatactttctctccttttttctctcctgcctcctctggccttcggactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagcaggccggctgttggacattctacataccaaggggcaaaggggctatgtggtcttcttggagagcctagaattttattacccagaactgtacaaactggtgactgggaaagagcccactcggagattctccaccattgtggtggaggaaggccacgagggcctcacgcacttcctgatgaacgaggtcatcaagctgcagcagcagatgaaggccaaggacctgcaacgctgcgagctgctggccaggttgcggcagctggaggatgagaagaagcagatgacgctgacgcgcgtggagctgctaaccttccaggagcggtactacaagatgaaggaagagcgggacagctacaatgacgagctggtcaaggtgaaggacgacaactacaacttagccatgcgctacgcacagctcagtgaggagaagaacatggcggtcatgaggagccgagacctccaactcgagatcgatcagctaaagcaccggttgaataagatggaggaggaatgtaagctggagagaaatcagtctctaaaactgaagaatgacattgaaaatcggcccaagaaggagcaggttctggaactggagcgggagaatgaaatgctgaagaccaaaaaccaggagctgcagtccatcatccaggccgggaagcgcagcctgccagactcagacaaggccatcctggacatcttggaacacgaccgcaaggaggccctggaggacaggcaggagctggtcaacaggatctacaacctgcaggaggaggcccgccaggcagaggagctgcgagacaagtacctggaggagaaggaggacctggagctcaagtgctcgaccctgggaaaggactgtgaaatgtacaagcaccgcatgaacacggtcatgctgcagctggaggaggtggagcgggagcgggaccaggccttccactcccgagatgaagctcagacacagtactcgcagtgcttaatcgaaaaggacaagtacaggaagcagatccgcgagctggaggagaagaacgacgagatgaggatcgagatggtgcggcgggaggcctgcatcgtcaacctggagagcaagctgcggcgcctctccaaggacagcaacaacctggaccagagtctgcccaggaacctgccagtaaccatcatctctcaggactttggggatgccagccccaggaccaatggtcaagaagctgacgattcttccacctcggaggagtcacctgaagacagcaagtacttcctgccctaccatccgccccagcgcaggatgaacctgaagggcatccagctgcagagagccaaatcccccatcagcctgaagcgaacatcagattttcaagccaaggggcacgaggaagaaggcacggacgccagccctagctcctgcggatctctgcccatcaccaactccttcaccaagatgcagcccccccggagccgcagcagcatcatgtcaatcaccgccgagcccccgggaaacgactccatcgtcagacgctacaaggaggacgcgccccatcgcagcacagtcgaagaagacaatgacagcggcgggtttgacgccttagatctggatgatgacagtcacgaacgctactccttcggaccctcctccatccactcctcctcctcctcccaccaatccgagggcctggatgcctacgacctggagcaggtcaacctcatgttcaggaagttctctctggaaagacccttccggccttcggtcacctctgtggggcacgtgcggggcccagggccctcggtgcagcacacgacgctgaatggcgacagcctcacctcccagctcaccctgctggggggcaacgcgcgagggagcttcgtgcactcggtcaagcctggctctctggccgagaaagccggcctccgtgagggccaccagctgctgctgctagaaggctgcatccgaggcgagaggcagagtgtcccgttggacacatgcaccaaagaggaagcccactggaccatccagaggtgcagcggccccgtcacgctgcactacaaggtcaaccacgaagggtaccggaagctggtgaaggacatggaggacggcctgatcacatcgggggactcgttctacatccggctgaacctgaacatctccagccagctggacgcctgcaccatgtccctgaagtgtgacgatgttgtgcacgtccgtgacaccatgtaccaggacaggcacgagtggctgtgcgcgcgggtcgaccctttcacagaccatgacctggatatgggcaccatacccagctacagccgagcccagcagctcctcctggtgaaactgcagcgcctgatgcaccgaggcagccgggaggaggtagacggcacccaccacaccctgcgggcactccggaacaccctgcagccagaagaagcgctttcaacaagcgacccccgggtcagcccccgtctctcgcgagcaagcttcctttttggccagctccttcagttcgtcagcaggtccgagaacaagtataagcggatgaacagcaacgagcgggtccgcatcatctcggggagtccgctagggagcctggcccggtcctcgctggacgccaccaagctcttgactgagaagcaggaagagctggaccctgagagcgagctgggcaagaacctcagcctcatcccctacagcctggtacgcgccttctactgcgagcgccgccggcccgtgctcttcacacccaccgtgctggccaagacgctggtgcagaggctgctcaactcgggaggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccgacctgagacggaggaggagttcctgcgcgtgtgccggctgaaggagaaggagctggaggccctgccgtgcctgtacgccacggtggaacctgacatgtggggcagcgtagaggagctgctccgcgttgtcaaggacaagatcggcgaggagcagcgcaagaccatctgggtggacgaggaccagctgtgaggcgggcgccctgggcagagagactctgtggcgcggggcatcctatgaggcaggcaccctgggcagagagatgcagtgggtgcggggggatcctgtggcccacagagctgccccagcagacgctccgccccacccggtgatggagccccggggggacagtcgtgcctggggaggagcagggtacagcccattcccccagccctggctgacctggcctagcagtttggccctgctggccttagcagggagacaggggagcaaagaacgccaagccggaggcccgaggccagccggcctctcgagagccagagcagcagttgaatgtaatgctggggacaggcatgctgccgccagtagggcggggacccggacagccaggtgactaccagtcctggggacacactcaccataaacacatccccaggcaggacagatcggggaaggggtgtgtaccaggctatgatttctcttgcattaaaatgtattattatttcttt

SEQ ID NO: 114780 - DNA, 4147 bp, Homo sapiens
  Payload ID: 2423
  Gene Symbol: CARD14
  Gene Name: caspase recruitment domain family, member 14
  Uniprot ID: Q9BXL6
  ENST ID: ENST00000344227
  CDS Start-End: 169-3183
gctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgcggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccaccttttctcagcttctgaggctgcgatgcctcaggaactccagtttacagagaccagtgtgtttacttgtaaataaagcctctgcgtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttact

SEQ ID NO: 114781 - DNA, 4537 bp, Homo sapiens
  Payload ID: 2423
  Gene Symbol: CARD14
  Gene Name: caspase recruitment domain family, member 14
  Uniprot ID: Q9BXL6
  ENST ID: ENST00000573882
  CDS Start-End: 537-3551
agagattgggccacattcagtcctcgcttccctgggagggggaagagtttcactctggctcctaggctggaatgcagtggcaccatctcagctctctgcaacctccacttcccaggttcaagcgattctcctgcctcaccctcctgagtagctgggactacaggcgagcaccaccacagccggctaatttttctatttctagtagaaatggggtttcaccatgttggcaggctggtctcgaactctgacctcaagtgatctgcctgcctcagcctctgaaagtgctggattgcaggcgtgagccaccgcaccaggcctaaacagatttctttacaatctaccaccatgaacagcaagcattagcattggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgcggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccaccttttctcagcttctgaggctgcgatgcctcaggaactccagtttacagagaccagtgtgtttacttgtaaataaagcctctgcgtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttactaaaataaaaagcttttacaata

SEQ ID NO: 114782 - DNA, 582 bp, Homo sapiens
  Payload ID: 2423
  Gene Symbol: CARD14
  Gene Name: caspase recruitment domain family, member 14
  ENST ID: ENST00000575465
  CDS Start-End: 372-582
ctcgcttccctgggagggggaagctccgtcccacccagcagcccgcagagaaaggaggcagctggcaccacactgggctttggagacactgcggggactgtggaccccaccctgctgcacggagctcctgcaaaagcaaacctgagaaccttgcatacagatccctgcaagaggcatctgtctccagtggtccagcctctccttccaaatgaaaagaatcaagtcacaggaattcatgggtctgtaaggaatcgctcccatctgtgcccaggagattaacaaaggcggtggctgcagctctgtgagcagtggagaaaaattaggcacaacctgatatcctcccacaggagcggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccg

SEQ ID NO: 114783 - DNA, 1554 bp, Homo sapiens
  Payload ID: 2423
  Gene Symbol: CARD14
  Gene Name: caspase recruitment domain family, member 14
  ENST ID: ENST00000571450
  CDS Start-End: 1-1426
ctatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttct

SEQ ID NO: 114784 - DNA, 3766 bp, Homo sapiens
  Payload ID: 2423
  Gene Symbol: CARD14
  Gene Name: caspase recruitment domain family, member 14
  ENST ID: ENST00000575500
  CDS Start-End: 192-1673
ctcgcttccctgggagggggaaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggtgaggcctggctccagcacgtgcttctgggccgagagctgcctcaccctggtgccctataccctggtgcggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccaccttttctcagcttctgaggctgcgatgcctcaggaactccagtttacagagaccagtgtgtttacttgtaaataaagcctctgcgtggtgg

SEQ ID NO: 114785 - DNA, 562 bp, Homo sapiens
  Payload ID: 2423
  Gene Symbol: CARD14
  Gene Name: caspase recruitment domain family, member 14
  ENST ID: ENST00000576785
  CDS Start-End: 432-562
cactgccgttcagttcagccagagattgggccacattcagtcctcgcttccctgggagggggaaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttgcatacagatccctgcaagaggcatctgtctccagtggtccagcctctccttccaaatgaaaagaatcaagtcacaggaattcatgggtctgtaaggaatcgctcccatctgtgcccaggagattaacaaaggcggtggctgcagctctgtgagcagtggagaaaaattaggcacaacctgatatcctcccacaggagcggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcg

SEQ ID NO: 114786 - DNA, 2607 bp, Homo sapiens
  Payload ID: 2423
  Gene Symbol: CARD14
  Gene Name: caspase recruitment domain family, member 14
  Uniprot ID: Q9BXL6
  ENST ID: ENST00000570421
  CDS Start-End: 178-2400
tgacttcaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccaggtgagcagctgcctcgagctcggtgcgtccccagagaggcccacagggaaatggcacccagcctgcctcggcttcctcctcctgcccagcaatagagggtgggcgtggtgagacccccctaaggagggaagcctgccaagatcactgctgaagatgttgtttctttgtgatggatgctttatatattgcaaatgaaatgttcattctagaa

SEQ ID NO: 114787 - DNA, 613 bp, Homo sapiens
  Payload ID: 2424
  Gene Symbol: CARD16
  Gene Name: caspase recruitment domain family, member 16
  Uniprot ID: Q5EG05
  ENST ID: ENST00000375704
  CDS Start-End: 80-373
gtgtacacgccctgccaaaaaggaaggcgaaacatactttcagtttcagcccacacaagaagggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcaggtccgatacctggaaattagcttagtacacaagactcccaattactattttcttccttcccagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagtgaaagatatacttcaggcagttttgaaatgcagtggctttttcttaga

SEQ ID NO: 114788 - DNA, 686 bp, Homo sapiens
  Payload ID: 2424
  Gene Symbol: CARD16
  Gene Name: caspase recruitment domain family, member 16
  Uniprot ID: Q5EG05
  ENST ID: ENST00000375706
  CDS Start-End: 19-612
gggtaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagtgaaagatatacttcaggcagttttgaaatgcagtggctttttcttagaaccaattttattgagcggttctggaggaacatacttctgctccccttgcataaaggatctctatatcctagaatcccaggtttaggtaaagagttgcaaactggaactcataaattatcatagtcttcacccagtctgtctcttagaatttatttcccactgacacaaacaagccattttgtctgcttgtataaccc

SEQ ID NO: 114789 - DNA, 445 bp, Homo sapiens
  Payload ID: 2424
  Gene Symbol: CARD16
  Gene Name: caspase recruitment domain family, member 16
  ENST ID: ENST00000528513
  CDS Start-End: 159-445
gagaaaagccatggccggtgagtcttttactgttccaagaacaggtccctgggaagaaagagttgtggaaagggctggctcttctggaagccataattagtatctgtggaagtttagacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcagctcttcaggcagtgcaggacaacccagctatgcccacatgctcaagcccagaaggcagaat

SEQ ID NO: 114790 - DNA, 503 bp, Homo sapiens
  Payload ID: 2424
  Gene Symbol: CARD16
  Gene Name: caspase recruitment domain family, member 16
  Uniprot ID: Q5EG05
  ENST ID: ENST00000525374
  CDS Start-End: 18-311
gggaggagagaaaagccatggccgacaaggtcctgaaggagaagagaaagctgtttatccattccatgggtgaaggtacaataaatggcttactggatgaattattacagacaagggtgctgaaccaggaagagatggagaaagtaaaacgtgaaaatgctacagttatggataagacccgagctttgattgactccgttattccgaaaggggcacaggcatgccaaatttgcatcacatacatttgtgaagaagacagttacctggcagagacgctgggactctcagcaggtccgatacctggaaattagcttagtacacaagactcccaattactattttcttccttcccagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagt

SEQ ID NO: 114791 - DNA, 466 bp, Homo sapiens
  Payload ID: 2425
  Gene Symbol: CARD17
  Gene Name: caspase recruitment domain family, member 17
  Uniprot ID: Q5XLA6
  ENST ID: ENST00000375707
  CDS Start-End: 18-350
gggaggagagaaaagccatggccgacaaggtcctgaaggagaagagaaagcagtttatccgttcagtgggcgaaggtacaataaatggcttactgggtgaattattggagacaagggtgctgagccaggaagagatagagatagtaaaatgtgaaaatgctacagttatggataaggcccgagctttgcttgactctgttattcggaaaggggctccagcatgccaaatttgcatcacatacatttgtgaagaagacagtcacctggcagggacgctgggactctcagcaggtccaacatctggaaatcaccttactacacaagattctcaaatagtacttccttcctaggttcaactttcatttgagcagccagatgataaagcacagatgcccagcactgaaagagttacttcgacaagacgtttctatctcttcccagtacattaaaataaggaagctgtatg

SEQ ID NO: 114792 - DNA, 652 bp, Homo sapiens
  Payload ID: 2426
  Gene Symbol: CARD18
  Gene Name: caspase recruitment domain family, member 18
  Uniprot ID: P57730
  ENST ID: ENST00000530950
  CDS Start-End: 1-273
atggctgaccaactcttgcgtaaaaagagaagaatttttatccattcagtgggtgcaggcacaataaatgccttgctggattgcctattagaggatgaagttattagccaggaagacatgaacaaagtgagagatgaaaatgacactgtcatggataaggctcgagtcttgattgaccttgttactggaaaaggacccaagtcttgctgcaaatttatcaagcatctctgtgaagaagaccctcaacttgcctcaaagatgggtttgcactaagagagaagatggaactctggagcacttcagagacttcccagagcttcttccaagggagaagatattctcgtgaaagaaaaaaacaaaacaaaacaacagtgcttttttcaaacctgattaatttcatcaatttccaataaatctttcattctctcatattactttcttcttattctttctctcctcataccaacagaggataattcatcaataataatgaaggtcatgatgattgtaatgtaattaagaaagtccctccctttcccttcctttctgtttagttcctttgcaatcctgtagagacatgtacagcttactttggtgcttttagcactgagagtctgctgtgatgggaataaaatgaagtcccagctcagaa

SEQ ID NO: 114793 - DNA, 627 bp, Homo sapiens
  Payload ID: 2426
  Gene Symbol: CARD18
  Gene Name: caspase recruitment domain family, member 18
  ENST ID: ENST00000526823
  CDS Start-End: 315-470
agtttcccaggtcactcagtgagcatatgtaggtaatgctagaatcagaaggaagtacgtggagtaaatgcaaaggtataagaccgttccttgggattactgtacttgtggagagaaatgtttaaatgattgttaccctgttggtaaattgagagggaaattgtgtcatgttcattatttgaggaatctttgtgcttccaacagaccaactcttgcgtaaaaagagaagaatttttatccattcagtgggtgcaggcacaataaatgccttgctggattgcctattagaggatgaagttattagccaggaagacatgaacaaagtgagagatgaaaatgacactgtcatggataaggctcgagtcttgattgaccttgttactggaaaaggacccaagtcttgctgcaaatttatcaagcatctctgtgaagaagaccctcaacttgcctcaaagatgggtttgcactaagagagaagatggaactctggagcacttcagagacttcccagagcttcttccaagggagaagatattctcgtgaaagaaaaaaacaaaacaaaacaacagtgcttttttcaaacctgattaatttcatcaatttccaataaatctttcattctctcat

SEQ ID NO: 114794 - DNA, 422 bp, Homo sapiens
  Payload ID: 2426
  Gene Symbol: CARD18
  Gene Name: caspase recruitment domain family, member 18
  ENST ID: ENST00000532895
  CDS Start-End: 195-350
agaggcagggtgggaagatgcccagacttgcacagcgtttttgaaggaacagataaaggccaggaagaatctgggatcctactgaccaactcttgcgtaaaaagagaagaatttttatccattcagtgggtgcaggcacaataaatgccttgctggattgcctattagaggatgaagttattagccaggaagacatgaacaaagtgagagatgaaaatgacactgtcatggataaggctcgagtcttgattgaccttgttactggaaaaggacccaagtcttgctgcaaatttatcaagcatctctgtgaagaagaccctcaacttgcctcaaagatgggtttgcactaagagagaagatggaactctggagcacttcagagacttcccagagcttcttccaagggagaagatattctcgtg

SEQ ID NO: 114795 - DNA, 855 bp, Homo sapiens
  Payload ID: 2427
  Gene Symbol: CARD19
  Gene Name: caspase recruitment domain family, member 19
  Uniprot ID: Q96LW7
  ENST ID: ENST00000375464
  CDS Start-End: 129-680
aaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcagaactcagattgcacagagctagactcgggcagccagagcggcgagctgagtaacaggggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaggttctctc

SEQ ID NO: 114796 - DNA, 2291 bp, Homo sapiens
  Payload ID: 2427
  Gene Symbol: CARD19
  Gene Name: caspase recruitment domain family, member 19
  Uniprot ID: Q96LW7
  ENST ID: ENST00000466409
  CDS Start-End: 129-815
aaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcgtaagttccacatcaccaaccatgcatgcttggtgctggcccggggagggcaccccagcctgccgttgatggcatggatgtcctccatgaccacccaagtctgctgcagcccaggcctggcatcccctctcgcctcagcccctccccagaggccaccctctggccccgaggggagagtgtggcaggcacaggcagtgcagatgttggtctctgtctcccactttctcccccttcctccgtctctctctcatggcagttttcacacagcatggggcatcttatacgtccactcttgcccttccttttctaacctcattccacggggatcccttcatgtctgtgtggacagcaaccttgttcccacagctgcatggcgctcctaggcggtcccagctggaattacccaaccccatgacggaccctttcattgcagcgatctgcacacgtgtgggtgtttccataggacattgtcaggcacggatggctggtccgaagcacgtgcatttcagttttgaggctcctgtcctcaggcagtgtggactcaggccctgggagtcatgtggatgccagtagcctgggcccacagagctgctgggatgtggggggcatatcaagttgaagatggcaactctgatctgacgcctctgtgctcagggcccctggaggaggggctactgccccttggcccttagacaacaggacagagaccagagggactgggcggcttgtcccaggctactgggctgtggtctctgaccccctggaggcctccccacgcctcacagaacacagtgcagacggtgggcggggagagctcgaggggaggcccagccctgcaggtgggactggctctccctccccagccacgagtatgccacagggggctttcaaaaccaggcagggccaagccttggccccactggaggtagagcaccttctgtggctcccgggtgcctttaggcccgtccaggagttggagcagaggagaagacccagactgtgcatagttccctgaggagggctagcctcaggtgccacagcctggttcggcctggcggccccaggaggcagcagcaaccttgggcttcctgcggggtgactaccttgccctccggccctgcccgttgactaactatgctctgtggttttgtttccagagaactcagattgcacagagctagactcgggcagccagagcggcgagctgagtaacaggggtaacacctccctgctgcccctccctctctctccctctctctccctctctctttaccctccccagggctccatctccgcctcaggggcttctccaccccaagtctggctccattcctggccttctgttggtgacagaccccccccctaaggtgctcgtttgggggctcttcaggcagcacctcagcctggcacccccactcccctgcgcagcccccaggcctcaggaccccacccctctgaggcccaggggagccctgttcacgctggtttctccccaggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaggttctctc

SEQ ID NO: 114797 - DNA, 4221 bp, Homo sapiens
  Payload ID: 2428
  Gene Symbol: CARD6
  Gene Name: caspase recruitment domain family, member 6
  Uniprot ID: Q9BX69
  ENST ID: ENST00000254691
  CDS Start-End: 200-3313
ccacaaggaccccggatcagagagtgctccgagctgggttgccccactgtgcttgtatctgcactctccaacactaggcatcattgacatgttaaagcttagccaaatagaattgttctttgtcattctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgacggctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttctccatgcaaatctactcagcctaagccaagccagccctggcctccccagtctaagccttctcagcccagaccccctcaacctaagtcatcctcaaccaatccttcacaagctaaggcacaccactcaaaagcagggcagaagaggggagggaagcattaaagagctaactccagagatctataaagcatatcctttacccaggccattcctatcatatagtaagcagaagagttgccatgaaagtaaaagactactgtcattagcatgtaaaacaaagaaagatatacatgactgaattggatatctttgtttgtttgtttgagacagagtttcactcttgttgcccaggctggagtgcaatggcacgatctcggctcaccgcaacctctgcttcctggcttaaagtgattctcctgcctcagcctctcgagtagctgggattacaggcatgcaccaccacacccagctaattttgtatttttagtagaggcagggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaagaaaaatatgaaaataattaagactagaatcaagcagtagataattgaatccaatcttgggtattattagataatgtataacttgcacccagggaatgggggtctatgagacaaccccacttggagaagaatggggttagggtctctaattgcaaagtgactgtacaataggacgaaagttgcctctgtgtctgagaaagtatcttagttgttggctgctccagaggtatctttgtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaa

SEQ ID NO: 114798 - DNA, 1094 bp, Homo sapiens
  Payload ID: 2428
  Gene Symbol: CARD6
  Gene Name: caspase recruitment domain family, member 6
  ENST ID: ENST00000381677
  CDS Start-End: 76-1008
attctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggcatgaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaaggctggtctcgaactcatgggcttaagcgatcctcccacgttggcctcccaaagtgctgggattacaggcgtgagccaccctgcctggcctgaaaattctgcctcaaacatctcaaacatccatttatattttgtacaagaaagtaaataaaatttttctttttaacattaaaaaaatt

SEQ ID NO: 114799 - DNA, 963 bp, Homo sapiens
  Payload ID: 2429
  Gene Symbol: CARD8
  Gene Name: caspase recruitment domain family, member 8
  ENST ID: ENST00000357778
  CDS Start-End: 115-963
ccagtagaaatgtaggtgcattggttccagtcctcagcaaatggtgcctcccaccaaagctgtccagcctggcttcccagaaagtcttatggaatttggtgtatacgtttagtcatgacaaggaacattcttgtgcctttctttgtctggattcaaagaagcgaaactgcatattctggtcactctcagctctcattcgatatctgtatcccaacagcacctgtgcaattcagcctccaggagtccttcaggccatgcctcttccaaccctttacctcttacatgtctagtattttcttttcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggtaagacagagtctt

SEQ ID NO: 114800 - DNA, 5263 bp, Homo sapiens
  Payload ID: 2429
  Gene Symbol: CARD8
  Gene Name: caspase recruitment domain family, member 8
  Uniprot ID: Q9Y2G2
  ENST ID: ENST00000391898
  CDS Start-End: 44-1657
ggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcctctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttatctgtgtcgtcccactgagtgcattcaccaccttttaaattttggtcactgtatgtatcagttctaaaatttccattttgttctctatattttaaatttcttgccttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctccagagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtatttttttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttttaaaaatatttttagtagagacagggtttcaccattttggccaggatggtcttgatctcctgacctcatgatccacccgcctcggccttccaaagtgctgggattacaggcatgagccaccgtgcctggcctcatttgagtatttttataatgtctcttttaaagtctttgtcagataatttcactgtacatgttattcagtgtttggtgtccactgagttgtcatttgccagacaagtggagatttttgcagctcatccttgtattctcagtagttccgatatgtaccctcgaaatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttatt

SEQ ID NO: 114801 - DNA, 5210 bp, Homo sapiens
  Payload ID: 2429
  Gene Symbol: CARD8
  Gene Name: caspase recruitment domain family, member 8
  Uniprot ID: Q9Y2G2
  ENST ID: ENST00000447740
  CDS Start-End: 141-1604
tgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcctctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttatctgtgtcgtcccactgagtgcattcaccaccttttaaattttggtcactgtatgtatcagttctaaaatttccattttgttctctatattttaaatttcttgccttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctccagagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtatttttttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttttaaaaatatttttagtagagacagggtttcaccattttggccaggatggtcttgatctcctgacctcatgatccacccgcctcggccttccaaagtgctgggattacaggcatgagccaccgtgcctggcctcatttgagtatttttataatgtctcttttaaagtctttgtcagataatttcactgtacatgttattcagtgtttggtgtccactgagttgtcatttgccagacaagtggagatttttgcagctcatccttgtattctcagtagttccgatatgtaccctcgaaatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttatt

SEQ ID NO: 114802 - DNA, 614 bp, Homo sapiens
  Payload ID: 2429
  Gene Symbol: CARD8
  Gene Name: caspase recruitment domain family, member 8
  ENST ID: ENST00000520007
  CDS Start-End: 359-571
atttcaaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacgtaagggacatctatttgttgggaaaaaattaaagatttggaatttt

SEQ ID NO: 114803 - DNA, 1903 bp, Homo sapiens
  Payload ID: 2429
  Gene Symbol: CARD8
  Gene Name: caspase recruitment domain family, member 8
  Uniprot ID: Q9Y2G2
  ENST ID: ENST00000521613
  CDS Start-End: 296-1759
agcttacttccctcagttctcagaaagcccacctcctctgcgagcgttatttcaaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgt

SEQ ID NO: 114804 - DNA, 622 bp, Homo sapiens
  Payload ID: 2429
  Gene Symbol: CARD8
  Gene Name: caspase recruitment domain family, member 8
  ENST ID: ENST00000522431
  CDS Start-End: 293-505
ggggctcctgaaactcacatggtaagcgctgcagaaacgcagcaggtggtgactttaggggaggacaggccaaatgggagaatccccttaagcttcggtttctctagttctcaacttcttttgaaataatgttcatagagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacgtaagggacatctatttgttgggaaaaaattaaagatttggaattttgctccattggtttatgtacattcataagaagcaaagacatgcaggttatttgcataaaaattagtatatatgtt

SEQ ID NO: 114805 - DNA, 2016 bp, Homo sapiens
  Payload ID: 2429
  Gene Symbol: CARD8
  Gene Name: caspase recruitment domain family, member 8
  ENST ID: ENST00000517510
  CDS Start-End: 248-496
atttcaaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcagggttactgtggcaacgccaacctttgaatccccctcctgcgcgctgagcggctcgtaaccatggagaccgaagcaggtttcccgcgtccgcctcctcacccagagactgcagccccggcgcccagaccctttggacaaggagatccaagcgggccccacaatgctcagcgggtaaagagctcctccccactcctctcccgccagcagacgaaggaaacaccccgcagcctgcacatgctcagatggagctctgggcccgcgggttctactgcgcaggccctcacactcagcaaagggacttggacgcgaaagcgctggtggcgctcagccggctgggagttgtagctttctggctgctacagcaggagatacaggtggccaatgggtgagctggctggaggtaggaacaaggttaaggaagctgggatcttcgtgcagactggatcgtcactatagcaacaatgaaacatcgggaagggctagttctgctaggcagtctgccattttcattctttcatctttttttttaactcaaagcttactttgcaacaggcactgttctaggcactggggatacaatggaaaacaaaatagagcttctattttggcggg

SEQ ID NO: 114806 - DNA, 2617 bp, Homo sapiens
  Payload ID: 2429
  Gene Symbol: CARD8
  Gene Name: caspase recruitment domain family, member 8
  Uniprot ID: Q9Y2G2
  ENST ID: ENST00000520153
  CDS Start-End: 231-1694
agagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacacca

SEQ ID NO: 114807 - DNA, 1709 bp, Homo sapiens
  Payload ID: 2429
  Gene Symbol: CARD8
  Gene Name: caspase recruitment domain family, member 8
  ENST ID: ENST00000521415
  CDS Start-End: 44-442
ggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaaga

SEQ ID NO: 114808 - DNA, 2056 bp, Homo sapiens
  Payload ID: 2429
  Gene Symbol: CARD8
  Gene Name: caspase recruitment domain family, member 8
  Uniprot ID: Q9Y2G2
  ENST ID: ENST00000519940
  CDS Start-End: 350-1963
gaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaaga

SEQ ID NO: 114809 - DNA, 1363 bp, Homo sapiens
  Payload ID: 2429
  Gene Symbol: CARD8
  Gene Name: caspase recruitment domain family, member 8
  ENST ID: ENST00000518450
  CDS Start-End: 1-211
tgggcagatgaaggaacccattcaacttgagattactgaaaaaagacatgggactttggtgtgggatactgaggtgaagccagtggatctccagcttgtagctgcatcagcccctcctcctttctcaggagtgaggatgtggcctggatgctgcccaatcttgcctagaactggctgcacctgcttgtgccttaacccttggttaccctaaatccctgttatccagactcattgggactgctctagatcttcactatccaatacgggttactgtggcaacgccaacctttgaatccccctcctgcgcgctgagcggctcgtaaccatggagaccgaagcaggtttcccgcgtccgcctcctcacccagagactgcagccccggcgcccagaccctttggacaaggagatccaagcgggccccacaatgctcagcgggtaaagagctcctccccactcctctcccgccagcagacgaaggaaacaccccgcagcctgcacatgctcagatggagctctgggcccgcgggttctactgcgcaggccctcacactcagcaaagggacttggacgcgaaagcgctggtggcgctcagccggctgggagttgtagctttctggctgctacagcaggagatacaggtggccaatgggtgagctggctggaggtaggaacaaggttaaggaagctgggatcttcgtgcagactggatcgtcactatagcaacaatgaaacatcgggaagggctagttctgctaggcagtctgccattttcattctttcatctttttttttaactcaaagcttactttgcaacaggcactgttctaggcactggggatacaatggaaaacaaaatagagcttctattttggcgggagatcgacttaataactgtgaacacgtgtcactggaaaaagcagtatgttaataagtaactgggctgctttgggaaaaatggaaatgcaggcgatgttagaacactggtacacacactaattcattcatcctcacaaagccctatagacaggtactattatgacccctcaactgtaacataggctggaaggtcacatgacaaggaagtagtggagctgggatttgaacccaggcagtctggcttcatacttgataagcttaatcacaatgccaaagtggtaaatagctgtgtggcataatttcaggtagtgataagtgctgtgaaggataaagcaaagaaaggggcagggatggctctttagagagactacttagggatggctttcaggaagaggtggcatttgagcaggggcccgagggattgatgtgacttgtgataaaagaaaaacttcagacgaattaaatttaaagaagtttaattggcta

SEQ ID NO: 114810 - DNA, 2884 bp, Homo sapiens
  Payload ID: 2429
  Gene Symbol: CARD8
  Gene Name: caspase recruitment domain family, member 8
  ENST ID: ENST00000522773
  CDS Start-End: 215-631
gtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccaggtacctgttctttttaaacctaatccacgtgtcagtttctctgctggtctctttcacgtcgaaataaacagatatctcaaggaatggatcaaaggcagagaatttgatggagttggttgccttgctccagaagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacacca

SEQ ID NO: 114811 - DNA, 751 bp, Homo sapiens
  Payload ID: 2429
  Gene Symbol: CARD8
  Gene Name: caspase recruitment domain family, member 8
  ENST ID: ENST00000519302
  CDS Start-End: 110-508
ggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacaggcgatagatgatgaggaagatcgcttccatggtgtgcgcctgcagacttcgcccccaatggaacccctgaactttggttccagttatattgtgtctaattctgctaacctgaaagtaatgcccaagtggatctccagcttgtagctgcatcagcccctcctcctttctcaggtgcagcctttgtgaaggagaaccaccggcaactccaagccaggatgggggacctgaaaggggtgctcgatgatctcca

SEQ ID NO: 114812 - DNA, 3041 bp, Homo sapiens
  Payload ID: 2429
  Gene Symbol: CARD8
  Gene Name: caspase recruitment domain family, member 8
  Uniprot ID: Q9Y2G2
  ENST ID: ENST00000520753
  CDS Start-End: 347-1525
gttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttcta

SEQ ID NO: 114813 - DNA, 5233 bp, Homo sapiens
  Payload ID: 2429
  Gene Symbol: CARD8
  Gene Name: caspase recruitment domain family, member 8
  ENST ID: ENST00000518622
  CDS Start-End: 190-438
ctagttctcaacttcttttgaaataatgttcatagagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcctctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttatctgtgtcgtcccactgagtgcattcaccaccttttaaattttggtcactgtatgtatcagttctaaaatttccattttgttctctatattttaaatttcttgccttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctccagagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtatttttttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttttaaaaatatttttagtagagacagggtttcaccattttggccaggatggtcttgatctcctgacctcatgatccacccgcctcggccttccaaagtgctgggattacaggcatgagccaccgtgcctggcctcatttgagtatttttataatgtctcttttaaagtctttgtcagataatttcactgtacatgttattcagtgtttggtgtccactgagttgtcatttgccagacaagtggagatttttgcagctcatccttgtattctcagtagttccgatatgtaccctcgaaatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 114814 - DNA, 500 bp, Homo sapiens
  Payload ID: 2429
  Gene Symbol: CARD8
  Gene Name: caspase recruitment domain family, member 8
  ENST ID: ENST00000519332
  CDS Start-End: 243-455
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacgtaagggacatctatttgttgggaaaaaattaaagatttggaattttgc

SEQ ID NO: 114815 - DNA, 579 bp, Homo sapiens
  Payload ID: 2429
  Gene Symbol: CARD8
  Gene Name: caspase recruitment domain family, member 8
  ENST ID: ENST00000521437
  CDS Start-End: 463-579
tttcaaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatccccaaagtggaactcacccaaatgtctatcgtctgctgaatggataagagaatatgtgatgtctccatacggtggaatattattcagccatgaaagcaaaggagggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatca

SEQ ID NO: 114816 - DNA, 673 bp, Homo sapiens
  Payload ID: 2429
  Gene Symbol: CARD8
  Gene Name: caspase recruitment domain family, member 8
  ENST ID: ENST00000523579
  CDS Start-End: 1-73
ccaccccgaagatattaagttccacttgtaccttgtccccagcgacgccttgctaacaaagacactattttagaggctgaggatacatcagtgaacaaaagaggcaaaaacatgacaaccaaagatattacatggaatgctataggaaaaatatatgtgcatatgataagaactataacaaataaagaaggttaagaaaattaatccagtggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaat

SEQ ID NO: 114817 - DNA, 3533 bp, Homo sapiens
  Payload ID: 2429
  Gene Symbol: CARD8
  Gene Name: caspase recruitment domain family, member 8
  ENST ID: ENST00000518979
  CDS Start-End: 190-438
ctagttctcaacttcttttgaaataatgttcatagagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcctctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaata

SEQ ID NO: 114818 - DNA, 567 bp, Homo sapiens
  Payload ID: 2429
  Gene Symbol: CARD8
  Gene Name: caspase recruitment domain family, member 8
  ENST ID: ENST00000522889
  CDS Start-End: 437-567
aaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatccccaaagtggaactcacccaaatgtctatcgtctgctgaatggataagagaatatgtgatgtctccatacggtggaatattattcagccatgaaagcaaaggagggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatga

SEQ ID NO: 114819 - DNA, 1931 bp, Homo sapiens
  Payload ID: 2429
  Gene Symbol: CARD8
  Gene Name: caspase recruitment domain family, member 8
  Uniprot ID: Q9Y2G2
  ENST ID: ENST00000520015
  CDS Start-End: 127-1305
agaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcct

SEQ ID NO: 114820 - DNA, 2587 bp, Homo sapiens
  Payload ID: 2429
  Gene Symbol: CARD8
  Gene Name: caspase recruitment domain family, member 8
  ENST ID: ENST00000519646
  CDS Start-End: 120-560
agagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaagcaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaagacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaaga

SEQ ID NO: 114821 - DNA, 2123 bp, Homo sapiens
  Payload ID: 2430
  Gene Symbol: CARD9
  Gene Name: caspase recruitment domain family, member 9
  Uniprot ID: Q9H257
  ENST ID: ENST00000371732
  CDS Start-End: 167-1777
gactgtggagttaagcagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcagcgcaggccccgaccagggcacacccaccggcccggcctcctgccacccgggggtgccgacgccctggggcgcagacttccccgagccgtcgctgacttggcctggaacgaggaatctggtgccctgaaaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgca

SEQ ID NO: 114822 - DNA, 1814 bp, Homo sapiens
  Payload ID: 2430
  Gene Symbol: CARD9
  Gene Name: caspase recruitment domain family, member 9
  Uniprot ID: Q9H257
  ENST ID: ENST00000371734
  CDS Start-End: 167-1645
gactgtggagttaagcagaacccatcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcccagccggactgccgggcattggggccgtttgttaagcggcactcattttgcggaggccatgcgggtgctcaccacccccatgcacacgccatctgtgtaacttcaggatctgttctgtttcaccatgtaacacacaatacatgcatgcattgtattagtgttagaaaacacagctgcgtaaataaacagcacgggtgacccgca

SEQ ID NO: 114823 - DNA, 1912 bp, Homo sapiens
  Payload ID: 2430
  Gene Symbol: CARD9
  Gene Name: caspase recruitment domain family, member 9
  Uniprot ID: Q9H257
  ENST ID: ENST00000489932
  CDS Start-End: 145-1245
catcaggaagtgcacaggcgtccggcgtgctcctccctccctgcagccccgggcagcatctcccagaggctccgcggcccaggctcctggtgtgtctgcagtgcaggtggctcctggaagaccctcagcctgcctgctgaggccatgtcggactacgagaacgatgacgagtgctggagcgtcctggagggcttccgggtgacgctcacctcggtcatcgacccctcacgcatcacaccttacctgcggcagtgcaaggtcctgaaccccgatgatgaggagcaggtgctcagcgaccccaacctggtcatccgcaaacggaaagtgggtgtgctcctggacatcctgcagcggaccggccacaagggctacgtggccttcctcgagagcctggagctctactacccgcagctgtacaagaaggtcacaggcaaggagccggcccgcgtcttctccatgatcatcgacgcgtccggggagtcaggcctgactcagctgctgatgactgaggtcatgaagctgcagaagaaggtgcaggacctgaccgcgctgctgagctccaaagatgacttcatcaaggagctgcgggtgaaggacagcctgctgcgcaagcaccaggagcgtgtgcagaggctcaaggaggagtgcgaggccggcagccgcgagctcaagcgctgcaaggaggagaactacgacctggccatgcgcctggcgcaccagagtgaggagaagggcgccgcgctcatgcggaaccgtgacctgcagctggagattgaccagctcaagcacagcctcatgaaggccgaggacgactgcaaggtggagcgcaagcacacgctgaagctcaggcacgccatggagcagcggcccagccaggagctgctgtgggagctgcagcaggagaaggccctgctccaggcccgggtgcaggagctggaggcctccgtccaggaggggaagctggacaggagcagcccctacatccaggtactggaggaggactggcggcaggcgctgcgggaccaccaggagcaggccaacaccatcttctccctgcgcaaggacctccgccagggcgaggcccgacgcctccggtgcatggaggagaaggagatgttcgagctgcagtgcctggcactacgtaaggactccaagatgtacaaggaccgcatcgaggccatcctgctgcagatggaggaggtcgccattgagcgggaccagagcacacaaatggaggggctgtgaccagcctccgcgcccagcggcttgacgtcctccggagcctctgcttggagttgggcggccgggccgagggcccagggcaagcttggggccctcactgagggtcggccttgtgctgtcccgtcaggccatagccacgcgggaggagctgcacgcacagcacgcccggggcctgcaggagaaggacgcgctgcgcaagcaggtgcgggagctgggcgagaaggcggatgagctgcagctgcaggtgttccagtgtgaggcgcagctactggccgtggagggcaggctcaggcggcagcagctggagacgctcgtcctgagctccgacctggaagatggctcacccaggaggtcccaggagctctcactcccccaggacctggaggacacccagctctcagacaaaggctgccttgccggcggggggagcccgaaacagccctttgcagctctgcaccaggagcaggttttgcggaacccccatgacgcaggcctgagcagcggggagccgcccgagaaggagcggcggcgcctcaaagagagttttgagaactaccgcaggaagcgcgccctcaggaagatgcagaaaggatggcggcagggggaggaggaccgggagaacaccacgggcagcgacaacaccgacactgagggctcctagccgcagcag

SEQ ID NO: 114824 - DNA, 4405 bp, Homo sapiens
  Payload ID: 2431
  Gene Symbol: CASZ1
  Gene Name: castor zinc finger 1
  Uniprot ID: Q86V15
  ENST ID: ENST00000344008
  CDS Start-End: 321-3821
gcatgcgcgcccgcggcgctccatcccaaacacacacacatttttcccccggacttggaaagtcacccaaagccgccccaagtgcaggcaaacagaccttgctgactgaaggcaaagactcctccatcccacctgccctcccagctgccacggccatcgacccctcctttacaaggggctcctgcaactccccagcagcacgtgttggaatggacttcggaccctggcctcttgggatgcaaaggatgaagtgacacccccagctacatccgaggaggttctaggacctgctacgagagtttgggaccaaggagaagagaatggatcttggaacagctgagggcacccggtgcacggacccgcctgcaggcaagcccgccatggcgcccaaacgcaagggtggcctgaagctgaacgccatctgcgccaagctgagccgccaggtggtggtggagaagcgagctgacgccggctcccacacggagggcagcccatcgcagccccgggaccaagagcgcagtggccctgagtctggggcagcccgggccccccgcagcgaggaagacaagagacgggcagtgatcgagaagtgggtgaacggggagtacagcgaggagccggcacccacacccgtgttggggcggattgcccgcgagggcctggagctgcctcccgagggtgtctacatggtgcagccccaggggtgcagcgatgaggaagaccacgcggaggagccctccaaggacggcggtgccctggaggagaaggattcggacggggcagcctccaaggaggacagcggccccagcaccaggcaggcttcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccagcgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgcctttccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaagtgagtccctcgatgagccgggagtcccgcgttcccctcgcgtctcgggagtaggtgctagcaagggcgctaggaggccctgttcctcactgcggatggtgctgctgtccccagcctctctggggcatggccatcgggtgatgtccttctagccaaagatgctgctgctcctacctcactgcctgtcccagagcaggccagcccgcgtgggccgatggtggcggcagtggctactgctcctgcagggcatgtggtgatcctgccagggccaggtggggtggactgggcgtggtggtcctcagaggacaactcccagcctgacaaggagggctgcgtctccctccgagcctccgtattggcctcctctgtggctcacacccatggctgaatctctgcagggcacgtgaagtcacgggtaggggccaggcccctccaggccgtcactggcctgcacagtggtctgagctcttgggtggaagggaccctcctcactggatggtggtggctccttgcagggagaacggtgactttgtattgtcatgtgtgcggcttcctgttctcaataaaagtaataaattggattattta

SEQ ID NO: 114825 - DNA, 7936 bp, Homo sapiens
  Payload ID: 2431
  Gene Symbol: CASZ1
  Gene Name: castor zinc finger 1
  Uniprot ID: Q86V15
  ENST ID: ENST00000377022
  CDS Start-End: 319-5598
atgcgcgcccgcggcgctccatcccaaacacacacacatttttcccccggacttggaaagtcacccaaagccgccccaagtgcaggcaaacagaccttgctgactgaaggcaaagactcctccatcccacctgccctcccagctgccacggccatcgacccctcctttacaaggggctcctgcaactccccagcagcacgtgttggaatggacttcggaccctggcctcttgggatgcaaaggatgaagtgacacccccagctacatccgaggaggttctaggacctgctacgagagtttgggaccaaggagaagagaatggatcttggaacagctgagggcacccggtgcacggacccgcctgcaggcaagcccgccatggcgcccaaacgcaagggtggcctgaagctgaacgccatctgcgccaagctgagccgccaggtggtggtggagaagcgagctgacgccggctcccacacggagggcagcccatcgcagccccgggaccaagagcgcagtggccctgagtctggggcagcccgggccccccgcagcgaggaagacaagagacgggcagtgatcgagaagtgggtgaacggggagtacagcgaggagccggcacccacacccgtgttggggcggattgcccgcgagggcctggagctgcctcccgagggtgtctacatggtgcagccccaggggtgcagcgatgaggaagaccacgcggaggagccctccaaggacggcggtgccctggaggagaaggattcggacggggcagcctccaaggaggacagcggccccagcaccaggcaggcttcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccagcgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgcctttccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaacgatccttgcctcgccacggactgcaagtacgccaacaagttccacttccactgtctctttgggaactgcaagtacgtctgcaaaacgtctggcaaggccgaatcccactgcctggaccacatcaaccccaacaacaacctggtgaacgtgcgagaccagtttgcatactactctctgcagtgtctctgtcccaaccagcactgcgagttccgaatgcgtgggcactaccactgcctccgcaccggctgctattttgtgaccaacatcaccaccaagctcccctggcacatcaagaagcatgagaaggcggagcggcgggcagccaatggcttcaaatacttcaccaagcgcgaggagtgtggcaggctaggttgcaagtacaaccaggtgaacagccacttccactgcatccgggagggctgccagttctccttcctcctcaagcaccagatgacctcccacgcgcggaagcacatgcggaggatgctggggaagaacttcgaccgcgtgcccccctcccagggccccccaggcctgatggatgctgagacagatgagtgcatggactacactggctgcagcccaggcgccatgtcctctgagtcatccaccatggaccggagctgctccagcacccccgtgggtaacgagagcaccgcggcagggaacaccatctctatgccgacagcctcgggggccaaaaagcgcttctggatcatcgaggacatgtcgcccttcggcaagcggcggaagacggcgtcctcccggaagatgctggacgagggcatgatgctggagggcttccggcgcttcgacctttacgaggactgcaaggacgcagcttgtcagttctcgctcaaggtcacccactaccactgcacgcgcgagaactgcggctacaagttctgcgggcgcacgcacatgtacaagcacgcgcagcaccacgaccgcgtggacaacctggtgctggacgacttcaagcgcttcaaggcctcactcagctgccacttcgccgactgccccttctcgggcaccagcacgcacttccactgcctgcgctgccgcttccgctgcaccgacagcaccaaggtcacggcgcatcgcaagcaccacggcaaacaggacgtgatcagcgccgcgggcttctgccagttcagctccagcgccgactgcgccgtgcccgactgcaagtacaagctcaagtgctcgcacttccactgcaccttcccgggctgccgccacacggtggtgggcatgtcgcagatggactcgcacaagcgcaagcacgagaagcaggagcgcggcgagcccgcggcagagggccccgcgcccgggcctcccatcagtctggacggctccctgtcgctgggcgccgagccgggctcgctgctcttcctgcagtcggcggccgccggcctgggcctggcgctgggcgacgcgggcgaccccggcccgcccgacgccgccgcccccgggccgcgcgagggcgccgccgccgccgccgccgcagctggggagtcctcgcaggaggacgaggaggaggagctggagctgccggaggaggaggccgaagacgacgaggacgaggacgacgacgaggacgacgacgacgaggacgacgacgaggacgacgacgacgaggacctgcgcaccgactcggaggagtcgctgcccgaggcggcggcggaggcggcgggcgcgggcgcgcggaccccggccttggcggcgctggcggccctgggcgcccccggccccgcgcccactgcagcctcctcgccctagcggcgcccgcgggtggccctggcggcggcctcggcctcggcctcgggagcggcgccgccccgcgcgaagcggcccctgggcagagccccgcgccccgccggtgcttccggaccccgagtccgtctcaggacagaggcggggacccctctggtgctccgcggccgaggacacaggcggcggcggtggccctgctctagggaggccgggtctcttcagggaaacagaaggtgctcttgtcccggggtagggaacctaggagcaggggtcccgggcgaatgcggcgcagctcccggccgctgccccggcgcccctccccgcggccgattcggccccgcgaccattgctcaggactgggacgggcgctgggggccaccgggacccccaccgcgcgccaccagggcggggtggctcctggagccgctggcggggcctccctcatgcagctaggatcctcccccctgcccagggggagacgggcagaaggcagtcagcacgggtgacactacagggaccgtggaggaagcctcacgggagtagcagccgcggagctccagctcagccccaccccagggcccggctgctcccccaggcctgggtcgggtctgtttggcgactccctggccccagcctccgccccagggaaaccgaggctgcgtccaaaacccagagtagcccgctgggggccggggcggggtctcggccaccctggtggtgcaaacaggaaggatgcgcctggttttggctttaatgttcaaaatggaaaaaaatacaagaaagttgtacagtatttttcctgtaaaggttattattctacatagaacaaaaaggaagaaagcaggcgtggtgagagtgcagacccgcctgggcccggcctgaggttggaggctcagtcccgtttatcctgtgggatttggtccagggtttttgtagaggccttaactgtttgaggctgtctgtcttcacaatagcactgatgggagctgcgtgattccaactcttaacttgaattttgtagagacaagaaaaaaggactattactgttgatccaagtttgtagttaatttaacatttgagttctctcttggtgatgcgtgtggctttatagggcttttttttttttccagtttgttttattactttgtttgggatgcttcttcgctggtgcagtctacccagattgggttccctttgcaaaacatcccccttcctggagatgatgatgccatcgaagcccgggccagggcctgacctggcaggcacacacctggccagtggctctgaggtccccggggaccgagtcccctgcgagggcaggctgcccgaggccacacctgcccaccttccctactccaggccaccagctggtgtcagattgggccaccgggagagaacaggcctaggagggaatggaaggctggcggggaggctgtcatccagaagcctcctccccagaggtctccaggaggaacctggctcaactggggggcagtggtttacttttcccttttttcttcctttcttttgtcctctcagctgcccacagccagaaagccaggaccacccgaactggacagggagcagggagggaggagtggtcgcacggagcgtacctgattcaacaggaaatcagttattttctaaaacagcccctaccagagcctcctgaactctgtgggcaccacgtgctgctgtgagcatctgcccagacagtgacccgccacaggccccgggcgtctgtggaaggagttttgtaaaggaaaaaaaaacacacacacacaaacattttttcaatgtagcaaaatcaaacttaaaaaaaaaaaagaagaaaagaagaagatgccgacagtgcggagtctagccttttgtaaacttcatattgcacactaggactataagccattgctagctcattttgaattttaacgtgtaatttttgttttattttctttctgtggggaaacaatgcttgatccaccaatgctctttttaatgttttataactatgtatgtgtatatatataaatatcaaataatatgtatgcacatatgtgtgtgtatatatctatatgtatatacatatatagatatatagagatatatagagaggttttgagacaaaaaaaatacagaacgtgaaacccgagctgaacagcgtgtgctctgattacttgaatctggtctcctcggcacctggttattaagaactgaatatttttccacttgaatttagtgctattagaaatttaatatatgtgttttatttatttgatttttttttttttttttgcatgactgatgcaaggtttgacattttcactcaataaaaactggaaaaaaa

SEQ ID NO: 114826 - DNA, 695 bp, Homo sapiens
  Payload ID: 2431
  Gene Symbol: CASZ1
  Gene Name: castor zinc finger 1
  ENST ID: ENST00000447850
  CDS Start-End: 1-695
cgaatgcgtgggcactaccactgcctccgcaccggctgctattttgtgaccaacatcaccaccaagctcccctggcacatcaagaagcatgagaaggcggagcggcgggcagccaatggcttcaaatacttcaccaagcgcgaggagtgtggcaggctaggttgcaagtacaaccaggtgaacagccacttccactgcatccgggagggctgccagttctccttcctcctcaagcaccagatgacctcccacgcgcggaagcacatgcggaggatgctggggaagaacttcgaccgcgtgcccccctcccagggccccccaggcctgatggatgctgagacagatgagtgcatggactacactggctgcagcccaggcgccatgtcctctgagtcatccaccatggaccggagctgctccagcacccccgtgggtaacgagagcaccgcggcaggctgcccggctcctcctcctcctcctcttcctcctcctgcggccgctggtgatgaggctgcccgcacggccccgcagccgccagcgactccatccttctcgccggccacgctccggccgcccctcccccccctcccctgcctcttctctccgtcctgtctctcatactctctgctcagtgccactctcggagccggccggggcctggcccatcccacctgcagcccgcccagcttcccgcc

SEQ ID NO: 114827 - DNA, 3925 bp, Homo sapiens
  Payload ID: 2432
  Gene Symbol: CECR1
  Gene Name: cat eye syndrome chromosome region, candidate 1
  Uniprot ID: Q9NZK5
  ENST ID: ENST00000262607
  CDS Start-End: 213-1748
ttgggaaacccctacctgtctgtacctgtaggtcttttctctggggtctggaagaagaatccttcaatatcttgccttctggtaatctgagagcagggcgagaaaaggaagatcagagttccacccttaaatctgtaggttttcactcccccactctcctttgcagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaa

SEQ ID NO: 114828 - DNA, 3195 bp, Homo sapiens
  Payload ID: 2432
  Gene Symbol: CECR1
  Gene Name: cat eye syndrome chromosome region, candidate 1
  Uniprot ID: Q9NZK5
  ENST ID: ENST00000330232
  CDS Start-End: 206-1018
gatgtcgaaactaaagcctggaaaggtcaaagagcttgatgaaggtcaaataggtagtaaggggtggctggacccagaccagggctcctaagttcgtcgctttcctcaccgcgctgggctctctgagcgtcctaatagccacgcccacctcaaatggcgatcccagagagcatctggcttcaattttcctttttccggaggggagatggattccctggaatggaactgggctctggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaa

SEQ ID NO: 114829 - DNA, 4505 bp, Homo sapiens
  Payload ID: 2432
  Gene Symbol: CECR1
  Gene Name: cat eye syndrome chromosome region, candidate 1
  Uniprot ID: Q9NZK5
  ENST ID: ENST00000399837
  CDS Start-End: 277-1812
aaactcagatgcacacagcaagcatgcatgtaagccacacacttgccactctggctgcctcagcactgcagagcccctctccccggcctctagttggatccctggtgcacactggagggaaataaaacctaccccaacaggaagtgaaacagttggtgagcttttccggtgctctgcacagatgctggggcgctgagcaaacagccctcagtttctggagctgttccgagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaatgagtggctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgc

SEQ ID NO: 114830 - DNA, 3986 bp, Homo sapiens
  Payload ID: 2432
  Gene Symbol: CECR1
  Gene Name: cat eye syndrome chromosome region, candidate 1
  Uniprot ID: Q9NZK5
  ENST ID: ENST00000399839
  CDS Start-End: 272-1807
attcttcccgaatggcctcacgtgtgctccctatcatcacgccttttcagctaggcaacgctcagagtcacacctgagtggaggccgacgcccctttggaggcgactccagccataaaaagtcctgcttggagctggttttagccacagagggccaataaatggccccttctgaatgaggtgcccctgcacctctgcagagcctgctgccagcctccaggatctaactgggctctgattcaccgctcccaaccccacatccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaatg

SEQ ID NO: 114831 - DNA, 581 bp, Homo sapiens
  Payload ID: 2432
  Gene Symbol: CECR1
  Gene Name: cat eye syndrome chromosome region, candidate 1
  ENST ID: ENST00000441548
  CDS Start-End: 175-581
ggttttagccacagagggccaataaatggccccttctgaatgaggtgcccctgcacctctgcagagcctgctgccagcctccaggatctaactgggctctgattcaccgctcccaaccccacatccagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacat

SEQ ID NO: 114832 - DNA, 4278 bp, Homo sapiens
  Payload ID: 2432
  Gene Symbol: CECR1
  Gene Name: cat eye syndrome chromosome region, candidate 1
  ENST ID: ENST00000449907
  CDS Start-End: 176-1585
ggttttagccacagagggccaataaatggccccttctgaatgaggtgcccctgcacctctgcagagcctgctgccagcctccaggatctaactgggctctgattcaccgctcccaaccccacatccagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaatgagtggctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgc

SEQ ID NO: 114833 - DNA, 549 bp, Homo sapiens
  Payload ID: 2432
  Gene Symbol: CECR1
  Gene Name: cat eye syndrome chromosome region, candidate 1
  ENST ID: ENST00000543038
  CDS Start-End: 94-549
agttggtgagcttttccggtgctctgcacagatgctggggcgctgagcaaacagccctcagtttctggagctgttccgagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaact

SEQ ID NO: 114834 - DNA, 4137 bp, Homo sapiens
  Payload ID: 2432
  Gene Symbol: CECR1
  Gene Name: cat eye syndrome chromosome region, candidate 1
  ENST ID: ENST00000610390
  CDS Start-End: 269-1444
aaactcagatgcacacagcaagcatgcatgtaagccacacacttgccactctggctgcctcagcactgcagagcccctctccccggcctctagttggatccctggtgcacactggagggaaataaaacctaccccaacaggaagtgaaacagttggtgagcttttccggtgctctgcacagatgctggggcgctgagcaaacagccctcagtttctggagctgttccgaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaatgagtggctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgc

SEQ ID NO: 114835 - DNA, 4783 bp, Homo sapiens
  Payload ID: 2433
  Gene Symbol: CECR2
  Gene Name: cat eye syndrome chromosome region, candidate 2
  ENST ID: ENST00000262608
  CDS Start-End: 386-4291
cctgcccgacttcgagatcgaggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaagggaaaacgtccacagcgcacaaaggcagagttgcatcctaggtggatgtctgaccacctgtccatcaaacccgtcaagcaagaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtgagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatgaggccagcagtaccaggaacatttggccctctgcgaggatcagatcctgccaccttgtatggctcctctggagtcccggagccacaccccggggagcctgtgcagcagcgtcagcctttcaccatgcagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcaggaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtg

SEQ ID NO: 114836 - DNA, 6178 bp, Homo sapiens
  Payload ID: 2433
  Gene Symbol: CECR2
  Gene Name: cat eye syndrome chromosome region, candidate 2
  Uniprot ID: Q9BXF3
  ENST ID: ENST00000342247
  CDS Start-End: 419-4873
cgggggttgttgttgtggcgcgggcagccccgccccctcctcgtgggcggcccctcccccaggccccgcgtccggcccctccgcccctagccccatctgtttctccggcggggactcgattatattgtaggggactgggggcggccgccgccgcagccgcgggatggggcgagcgcgcggaccccgcgggcagccgcagccgcagccgcctcagtagttcgggcccccgcgccgccgccccccgcccggcgcccgccctcggctcctgcactcgccgagcggcggcagcagcgggaggagcgccccgccgcccccgccgaggaccgcgcggaggctgcggcgctgccgcggcgggagtcccaggtcggcgggcagagcgcgggcagcgaggggccgccgcctgtgccgcagcggggagatgtgcccagaggagggcggcgcggccgggctgggcgagctccgctcctggtgggaggtcccggccatcgcgcacttctgctcgctctttcgcaccgcgttccgcctgcccgacttcgagatcgaggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaagggaaaacgtccacagcgcacaaaggcagagttgcatcctaggtggatgtctgaccacctgtccatcaaacccgtcaagcaagaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtcctgtggatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtgagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatgaggccagcagtaccaggaacatttggccctctgcgaggatcagatcctgccaccttgtatggctcctctggagtcccggagccacaccccggggagcctgtgcagcagcgtcagcctttcaccatgcagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcaggaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatatgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagtt

SEQ ID NO: 114837 - DNA, 2144 bp, Homo sapiens
  Payload ID: 2433
  Gene Symbol: CECR2
  Gene Name: cat eye syndrome chromosome region, candidate 2
  ENST ID: ENST00000355219
  CDS Start-End: 1-657
tcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcagggttcaagcgattctcctgcctcatcctcccaagtagctgggattacaggtgcccgccaccacacctggctgagttttgtatgatactataaacttaataaccacagtttgagagctgtaagcaagcctgtgtcaacattgctgccatgtggagacactctgaccaagaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatatgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattac

SEQ ID NO: 114838 - DNA, 4833 bp, Homo sapiens
  Payload ID: 2433
  Gene Symbol: CECR2
  Gene Name: cat eye syndrome chromosome region, candidate 2
  ENST ID: ENST00000400585
  CDS Start-End: 439-4341
aggaaaaaggatgaacaaatgcctgtgtggtttcacttatatagtactcagcttgacgccatgtgaaatgaagaggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaagggaaaacgtccacagcgcacaaaggcagagttgcatcctaggtggatgtctgaccacctgtccatcaaacccgtcaagcaagaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtgagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatgaggccagcagtaccaggaacatttggccctctgcgaggatcagatcctgccaccttgtatggctcctctggagtcccggagccacaccccggggagcctgtgcagcagcgtcagcctttcaccatgcagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcaggaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtg

SEQ ID NO: 114839 - DNA, 9645 bp, Homo sapiens
  Payload ID: 2433
  Gene Symbol: CECR2
  Gene Name: cat eye syndrome chromosome region, candidate 2
  ENST ID: ENST00000612582
  CDS Start-End: 8-4336
ctaacaaatgccattcaaaatacagtggttctttaaagctgttgcagatggtttatctcttgagaaggagttagaagccgctcttcacagagatgacgtggagtttatcagtgacctgattgcctgcctgcttcagggctgctatcaacgaagagatatcacgcctcagacattccacagctacctagaggacatcatcaactaccgctgggagctcgaagaagggaagcccaaccctctgagggaagccagtttccaggacctgcctcttcgcacacgggtggagatcctgcaccgactctgtgattaccggctggatgcagacgatgtcttcgatcttctaaagggcctggatgcagacagtctccgtgtggagccattgggtgaagacaattctggggcactatattggtatttctatggaacacgaatgtacaaagaggacccggtgcaaggaaaatccaatggagaactctctttgagcagggaaagtgaaggacaaaaaaatgtctcaagtattcctggaaaaacgggaaaaagaagaggaagacccccaaaacggaagaaactgcaggaggagattctgttgagtgaaaagcaggaagaaaattccttggcatccgagccacagacaagacatgggtcccaagggccaggccaaggtacttggtggctcctgtgccagacagaagaggaatggagacaggtcaccgagagttttcgcgagaggacctcccttcgagaacggcagctctacaagctcctcagtgaggacttcctgcctgagatctgcaacatgatcgcccagaagggaaaacgtccacagcgcacaaaggcagagttgcatcctaggtggatgtctgaccacctgtccatcaaacccgtcaagcaagaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaagatcgagcgaagaggagaaagctcagggaagaaagggcatggctgctggctcaaggaaaggagctccctccagaactttcccatctggaccccaattcccccatgagagaggaaaaaaagactaaagacctctttgagttggatgatgatttcactgctatgtataaagttctagacgtggtaaaggctcacaaggattcctggcccttcttggaacctgtggatgaatcttatgcccctaactattatcagattattaaggcccccatggatatttccagcatggagaagaaactgaatggaggtttatactgtaccaaggaggaatttgtaaatgacatgaagaccatgttcaggaattgtcgaaagtataatggggaaagtagtgagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatgaggccagcagtaccaggaacatttggccctctgcgaggatcagatcctgccaccttgtatggctcctctggagtcccggagccacaccccggggagcctgtgcagcagcgtcagcctttcaccatgcagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcattcctccccggcatgggggggctccagcccggccaccagactttcctgaaagctcagaaattcctcccagccatatgtatcgatcgtacaagtacctgaatcgagtacactctgccgtctggaatgggaaccatggtgctacgaaccaaggacccttgggcccagatgagaagccccacctggggccaggaccctctcaccagcctcgcactctcggtcacgtgatggattcccgagtcatgagaccacctgtcccccccaaccagtggactgaacaatcaggcttcctacctcatggagttccttcctcagggtacatgcgaccgccctgcaagtctgccggacatcggttacagccacctccagtgccagcacccagttctttgtttggagcacctgcccaggctcttcggggggtgcagggaggggactccatgatggacagcccagagatgattgcgatgcagcagctctcctcccgcgtctgccccccaggtgtgccttaccacccccaccagcctgcacacccccgtttacctggcccttttccgcaggtagctcacccaatgtcagtcactgtgtcagcccccaagcctgccctgggcaaccctgggagggcaccggagaacagtgaagcacaagagcctgagaatgaccaagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcaggaatgcagatgcacccggtccagtcgcaggcctcgttcccaaagacccccacagcagcaacatcacaggaggaggtgccgcctcataagcctccaacacttcccctggatcagagctagtccaaggaggaaatgagccccaagcaatggaaagctgcacacgaagactggaatgtggagaactggggagtgccctgtcagctctattcccatcacctgctccaccccttcacggcgacccactcgtgccatacttgagctggagccagtcacgggccctaaaaggacactccttagatgactgacacacagattgcaaaggtcctcggccagggatctcttgcacagctgatgtagacagtcaggcaaaactaatgaacgtggagttaatgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatatgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagttgaattacactggattctccctcgttagcattctgtatttgattttagctgaaaggtcaccaaagttaggacccatgttttaaacttttgaatattccacaaaagaaaaaactaaggaaaatactgaaattacaggtctttgtaaagaatagcatatttttaagcatgcttttgggatagtagaagagtctctatgaaatattaatctgccctagtttcttataaattcagctgtgggaggggccagtagagtgtttccctccaattccaggattcctagtgaagcatggaactgtcgtgtttacagtttgctaaacatatgctgtccgtggaaaaggaagctaatcggaagcatccatgatacagagaaatgaaagccaagacaccagttccaggatgatggaagttcatatccgtacgcaaatgctgaacctggtgctgctgcctagggctcaggcagatttgagagttgagtagggaacacaggtgcctctaaggtataatgcacaaaaatacagattttctctcagagaggttttaattttaaatttgatgtatttgcaagtggattgagttttgagcctgtgttctcactggatcctaattcttgttagaaacctatcactggcataacctggtttagaagagtgaagaggacagaaggattgtggatgggtctgccctttagctagtatccgctaacatggggcattactacttcagtttctgtgtttgtgcagaagcagggaggaggtaaaaagctagtttggagctggttagacctggtctaggcccagagaatttggccactgacagcctttctcttttcctggtaatgctggtttgaatcagaggcctctcacttctccttaacaggagcactgacactgtgggcctctccccatgactaccccaggggcctgggtgggagtggctgtaagcagcagttgggccattgccccctttccttctgccctcgtggtccttgagcagttgtgtgcacactcttccaggtaatcctgtctcctctctctcccagtgaccgccccaatcagctgttgctagagcgatgctgtgaacgatacaggaaaagtcagtaaatccctttatccttaatctcccttcttggttttcgacagaaaatattaaggaagagcaataggaaatagaactactgtattataacactgtgaacaagaacatcagcagcagcagaattgtcagccttcctgcgtcctgtgtgggaatgtgtccatgccttataggtactagtgcttcgtccattgtccagggagtgtcctgagctttcactggtctttgaagtgcagatctgctataagctgtctggagctgcaaggttgcaggaatccacaggagcgtgagctgctgtgaacccctagcccacccatccccaagcaggatcttcttctcaccttttcttcctcctctagcacttctctttccaagtgtcttaagcagatgcaatgtcttaaagcagatgcaaatgcatttgccatcttctccattaggaaaatgatggttatgtgatatgttatatttaggaagtagtgtgtaaggtatcctgaaaaggtttgctctcaagctagaaggacatttcaccctgtgggtcactgtcaccttgtcagcgtgccggctctcagtggtccccaggaggatggggatagctgagatcgtggagaatgggaaataccattgcatctctttgatttaacactcatggctcacctttagtagagttgttaataagttagaaacttgtgtccctaaggcccaagagaaaagatgagcttcttgggaggattctgggtttgttttcccctcagaattaaaaaatagtttttaattcagctactttttcccctcagttaaaaggtagcaggagctattggctgaaatttgttacagtgaatgaatgtggagaataaataagaacaaaccctgtaggattcttgttgacgtaactttccatcccacctctccgcctctccttcatcaccagccttcatcaggttggtttagtttacctggccgtacacacgagctgctcatcaacagttcgtatcttctcactgagcccgggccagatgctctcagaaggccttctcatgctcctcttcgttaggcttagtgaaaaccttaagacctgcagtttgtgcccctcagttcagtcagacctcagctttaaatgtcgatttactctgtcttgttccctgaaagtgtttcttgtgactaagcatttggtgtcattatcccatgccatttatctgctgtatagttactatattatttttgctgattcctactgctggcagatgccatcccaggcccacaaaatcccagtgttgcagtcaccacagctgtcagaaacaagtttgcaatccatacttcttggttcaatttttttttttaatggacattcaaatctgtaaatactacactgctcttaagacctgatttgaaatttcacaggaaggcctaatcctatagtcacaaggtaaggacagttgagtagtgtaagaaccccaacctgcttgcagagaaccttggttttcatagaaaggaaaggctgaaggttttctagcattgttgcccttctttgtctgtcagtcagttcaccctctgtgattctccatggacccgcattgcagaaaatcagtcccatatattagtgagccatgtactgcccaatccgggggctcctggggtgtggtgtgtccaccagtgactctccggacactagcttcagtaaggatacttcttatttcggttgagaatgcagaggcttttattcgtggactcacatcactgcatagcacaaagaatgtgattgccatttgctgcgtgagaaaaagctgggctccctatttcttttttgggttggactctgccgtgcagccataggacaccaagcctcacgcactttccccttgggacagtagtgtttgggtgaatgttactgcatcccgttttttttcttttcttttttttttttttttttttgagacgaaatcttgctcttgtcccccagactggagtgcaatggcacgatctcggctcactgcaacctccacctcccaggttcaagggattcgtctgcctcggcctcccaagtagctgggactacaagcgcgcaccaccactcccagctaatttttgtatttttagtagaggcggggtttcaccatgttggccaggctggtctcaaactcctgacctcaggtgatccacccgccttggcctcccaacatgctgggattacaggcgtgagccaacacaccggaccttcattttttaaattaagctgggacacaagttttgcctccaggctggatgttgatcctgctctgtgctagacagatgtgcggagggactgttccgggctcggcttgaccttttcctacctagtttctccctcttgtcctgcacaagaggactaactgaactctaacgtcagaacggctgacgagcagttgattgtccttgcttgtgttgttgacaggggtgggtggggtgggagcaggggtatggatattgcataagttattgaaatgctgacccccgttcaggaaaccatgcagccccttcccttcccttcccttcccttcctttcccttccctagccagggctcaggtacctcactctcctgccttgtgcgtagctcctggggccccggtcagtccccagcagccttggcacacagtgtctggagcctctgctcctgctgcaaaagcagaaaccatgtgaaccttctggccagtactggaaaggggaatgctatttatttttatattgtgtatattttgtcgtggtctgctgattccctgtttcactgagagcgacacttacctcaatagttagttcaatattgtgtgttggataattttttaaaagaactttttaaaaagctttttgatccttggaggtctgtagatttatttccatatgaactggttattttgtataaagtacatgcttaaaatagc

SEQ ID NO: 114840 - DNA, 1735 bp, Homo sapiens
  Payload ID: 2434
  Gene Symbol: CECR5
  Gene Name: cat eye syndrome chromosome region, candidate 5
  Uniprot ID: Q9BXW7
  ENST ID: ENST00000155674
  CDS Start-End: 44-1225
ctggtggaccagctggctcctaaagaggagaggggactaaatcatgtatgcttggttctttcttcccagcttctctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgactcttgtga

SEQ ID NO: 114841 - DNA, 1799 bp, Homo sapiens
  Payload ID: 2434
  Gene Symbol: CECR5
  Gene Name: cat eye syndrome chromosome region, candidate 5
  Uniprot ID: Q9BXW7
  ENST ID: ENST00000336737
  CDS Start-End: 27-1298
gtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctga

SEQ ID NO: 114842 - DNA, 1118 bp, Homo sapiens
  Payload ID: 2434
  Gene Symbol: CECR5
  Gene Name: cat eye syndrome chromosome region, candidate 5
  ENST ID: ENST00000399852
  CDS Start-End: 5-676
ccggatggctgcgtggggctgtgtggctgcgctcggcgcggcgcgtgggctttgctggcgggcggcgcgcgcggctgcggggctccagggccgccccgcccgcaggtgctatgctgtgggccccgctcagcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccagtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcc

SEQ ID NO: 114843 - DNA, 4954 bp, Homo sapiens
  Payload ID: 2435
  Gene Symbol: CECR6
  Gene Name: cat eye syndrome chromosome region, candidate 6
  Uniprot ID: Q9BXQ6
  ENST ID: ENST00000331437
  CDS Start-End: 127-1863
aggtgcgagtccccactgctggggaggcggcgggccccggctcccctcggccgcctagcccgcctcgcccgcccggggttggcggggagggaacagctgggcggccccagagcccctcggaggacaatgcgcccggcgctcggccaccctcgctcggtctcctccgcgtccggttccttcccgccgcccccggcagccgcccggctgcagcccctcttcctccgcgggggctccttccgcggccggagaggctccggcgacagcagcaccagcaccagcaccagccgcgggggaggcggcggcagacgcggcgggggcggcggctccccgagcagcagcacgggcgccgagcgcgaggacgacgacgagagcctcagcgtcagcaagccgctggtgcccaacgccgcgctcctggggccgccggctcaggtgggcgcccccgccggccccgcgcctgtcgccttctcctcctcagcggccacctcctcctccacctccacgcccacctcctcctgcagcatgacagccgcggacttcggcgggggcgccgcggccggggccgtcgggggccccgggagccgctcggcggggggcgcgggcggcaccgggaccggcagcggcgcctcctgctgcccgtgttgctgctgctgcggctgcccagaccgccccggccgcagaggtcggcgccgcggctgcgcccccagtcccaggtgccgctggggctaccaggcgctgtccgtggtgctgctgctggcgcagggcggcctgctggacctgtacctcatcgccgtcaccgacctgtactggtgctcctggatcgccactgacctggtggtggtggtgggctgggccatcttcttcgccaagaacagccggggccgtcggggcggcgcagccagcggcgcgcacaaccaccacctgcaccaccaccacgccgcgccgcccctgcatctgcccgccccctcggccgctaccgctggggccaaggcacgcggagcccgcgggggcgccggcggcgcggggggcggcctgggggcggccgcggcagcgggcgagttcgccttcgcctacctggcctggcttatctactccatcgccttcactcccaaggtggtgctgatcctgggcacgtccatcctagacctcatcgagctacgcgcgcccttcggcaccacgggcttccgtctcaccatggcgctgtcggtgcccctgctctacagcttggtgcgggccatcagcgaggcgggcgcgcccccgggatcggcaggacccctgctgctgcagccccagcggcaccgcgcggccggatgcttcctgggcacgtgcttggacctgctcgacagcttcacgctggtggagctgatgctggagggccgcgtgccgctgcccgcgcacctgcgctacctgcttatcgccgtctacttcctcaccctcgcctcgccggtgctctggctctacgagctcaacgccgcggccgcagcggctgcatcctggggccaggcctccgggcctggcagctgcagccgccttctgcgcctgctgggcggctgcctggtggacgtgcccttgctggcgctgcgctgcctcctggtggtcagctaccagcagcccctctccatcttcatgctcaagaacctcttcttcctcggctgccggggcctggaggccctggagggctgctgggaccggggcaatcgggcctccccgagtcgggccagagggggctacggtgctccgccctccgcccctccaccacctccgccaccacctcagggaggctcccagctgggccactgcatctcggagaacgaggggggtgctcatggctatgtcaacaccctggctgtggcctctcagaattgagggtgaagggcacgggtccttgtttttgggttgagagtccccaacccccttgtcttctaccttctgtcacctagatttgatcagggtctatttggaagaggtaacccttttcagggctaagggccagggtgttcttctgcaccctggggtgaggacggcttggagggagaccagcagttaacggtgagggaggtaggtgcacttaccctctcctctcttctcctatcctaccccaatcctgacctccaaggggctggtacctctgcttcttgctttgcccacctccactctaattcccatccattaggaggagaggggtgctgggccttggaccttctcccttgcttagaagtgccagcctcttttaggctgtggttagtggccattgtcccatgccttgaaattgacccagaacccactttccactgatgtgtctcttggatttcttccaggtgatagatacaaagtgtatgtctctgtgtgtgtagtgttgttttctcgtgtccaccctgtggccctttgcaatgggtaggagatctggggaggccctgccccctacaccatacttatcaccaccctcctcttttctgcctggatttgtgaccatgaattcccaggaagagctgggcccctgggagctgcccaggtactccccttgaagggagaatctcacccaggatcttcctcaatactgctcctctcttctcagctcagggagaggaggggatccattctctaaggaccaaactgcaccctttcttgggtgagtgagcatttctacctccgtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatggccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttg

SEQ ID NO: 114844 - DNA, 3961 bp, Homo sapiens
  Payload ID: 2435
  Gene Symbol: CECR6
  Gene Name: cat eye syndrome chromosome region, candidate 6
  Uniprot ID: Q9BXQ6
  ENST ID: ENST00000399875
  CDS Start-End: 198-869
ctcgcctgtcttcaccgcggtccgctcggttcaccgcctgccccctctccctgccgcccggcccggctcgcccagtccagtggctccagtccggatctcgccgccgcccggcccaggtggtgctgatcctgggcacgtccatcctagacctcatcgagctacgcgcgcccttcggcaccacgggcttccgtctcaccatggcgctgtcggtgcccctgctctacagcttggtgcgggccatcagcgaggcgggcgcgcccccgggatcggcaggacccctgctgctgcagccccagcggcaccgcgcggccggatgcttcctgggcacgtgcttggacctgctcgacagcttcacgctggtggagctgatgctggagggccgcgtgccgctgcccgcgcacctgcgctacctgcttatcgccgtctacttcctcaccctcgcctcgccggtgctctggctctacgagctcaacgccgcggccgcagcggctgcatcctggggccaggcctccgggcctggcagctgcagccgccttctgcgcctgctgggcggctgcctggtggacgtgcccttgctggcgctgcgctgcctcctggtggtcagctaccagcagcccctctccatcttcatgctcaagaacctcttcttcctcggctgccggggcctggaggccctggagggctgctgggaccggggcaatcgggcctccccgagtcgggccagagggggctacggtgctccgccctccgcccctccaccacctccgccaccacctcagggaggctcccagctgggccactgcatctcggagaacgaggggggtgctcatggctatgtcaacaccctggctgtggcctctcagaattgagggtgaagggcacgggtccttgtttttgggttgagagtccccaacccccttgtcttctaccttctgtcacctagatttgatcagggtctatttggaagaggtaacccttttcagggctaagggccagggtgttcttctgcaccctggggtgaggacggcttggagggagaccagcagttaacggtgagggaggtaggtgcacttaccctctcctctcttctcctatcctaccccaatcctgacctccaaggggctggtacctctgcttcttgctttgcccacctccactctaattcccatccattaggaggagaggggtgctgggccttggaccttctcccttgcttagaagtgccagcctcttttaggctgtggttagtggccattgtcccatgccttgaaattgacccagaacccactttccactgatgtgtctcttggatttcttccaggtgatagatacaaagtgtatgtctctgtgtgtgtagtgttgttttctcgtgtccaccctgtggccctttgcaatgggtaggagatctggggaggccctgccccctacaccatacttatcaccaccctcctcttttctgcctggatttgtgaccatgaattcccaggaagagctgggcccctgggagctgcccaggtactccccttgaagggagaatctcacccaggatcttcctcaatactgctcctctcttctcagctcagggagaggaggggatccattctctaaggaccaaactgcaccctttcttgggtgagtgagcatttctacctccgtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatggccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttgt

SEQ ID NO: 114845 - DNA, 2302 bp, Homo sapiens
  Payload ID: 2436
  Gene Symbol: CAT
  Gene Name: catalase
  Uniprot ID: P04040
  ENST ID: ENST00000241052
  CDS Start-End: 90-1673
actcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggggcctttggctactttgaggtcacacatgacattaccaaatactccaaggcaaaggtatttgagcatattggaaagaagactcccatcgcagttcggttctccactgttgctggagaatcgggttcagctgacacagttcgggaccctcgtgggtttgcagtgaaattttacacagaagatggtaactgggatctcgttggaaataacacccccattttcttcatcagggatcccatattgtttccatcttttatccacagccaaaagagaaatcctcagacacatctgaaggatccggacatggtctgggacttctggagcctacgtcctgagtctctgcatcaggtttctttcttgttcagtgatcgggggattccagatggacatcgccacatgaatggatatggatcacatactttcaagctggttaatgcaaatggggaggcagtttattgcaaattccattataagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtggtgctccaaattactaccccaacagctttggtgctccggaacaacagccttctgccctggagcacagcatccaatattctggagaagtgcggagattcaacactgccaatgatgataacgttactcaggtgcgggcattctatgtgaacgtgctgaatgaggaacagaggaaacgtctgtgtgagaacattgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaacaga

SEQ ID NO: 114846 - DNA, 1319 bp, Homo sapiens
  Payload ID: 2437
  Gene Symbol: COMT
  Gene Name: catechol-O-methyltransferase
  ENST ID: ENST00000207636
  CDS Start-End: 166-765
cagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgtagggatggcctcctgtctgtgaggacgtgggcactgacaggcgctgttccaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaa

SEQ ID NO: 114847 - DNA, 2437 bp, Homo sapiens
  Payload ID: 2437
  Gene Symbol: COMT
  Gene Name: catechol-O-methyltransferase
  Uniprot ID: P21964
  ENST ID: ENST00000361682
  CDS Start-End: 383-1198
cggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaatatttagatataactcgacttagtacatccttctcaactgccattcccctgctgcccttgacttgggcaccaaacattcaaagctccccttgacggacgctaacgctaagggcggggcccctagctggctgggttctgggtggcacgcctggcccactggcctcccagccacagtggtgcagaggtcagccctcctgcagctaggccaggggcacctgttagccccatggggacgactgccggcctgggaaacgaagaggagtcagccagcattcacacctttctgaccaagcaggcgctggggacaggtggaccccgcagcagcaccagcccctctgggccccatgtggcacagagtggaagcatctccttccctactccccactgggccttgcttacagaagaggcaatggctcagaccagctcccgcatccctgtagttgcctccctggcccatgagtgaggatgcagtgctggtttctgcccacctacacctagagctgtccccatctcctccaaggggtcagactgctagccacctcagaggctccaagggcccagttcccaggcccaggacaggaatcaaccctgtgctagctgagttcacctgcaccgagaccagcccctagccaagattctactcctgggctcaaggcctggctagcccccagccagcccactcctatggatagacagaccagtgagcccaagtggacaagtttggggccacccagggaccagaaacagagcctctgcaggacacagcagatgggcacctgggaccacctccacccagggccctgccccagacgcgcagaggcccgacacaagggagaagccagccacttgtgccagacctgagtggcagaaagcaaaaagttcctttgctgctttaatttttaaattttcttacaaaaatttaggtgtttaccaatagtcttattttggcttatttttaa

SEQ ID NO: 114848 - DNA, 2217 bp, Homo sapiens
  Payload ID: 2437
  Gene Symbol: COMT
  Gene Name: catechol-O-methyltransferase
  ENST ID: ENST00000403184
  CDS Start-End: 257-964
cccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggtgagccccaaccaggatggcatccgtgccagctgctgcccagagcccattcagtcagcctcagcctctccaaagagccaggcattccagtagagccctgtgtggacacagctcgctctggaggcaccacctgaggtctgggagtgtgggggactgaggaggccctgtggtgggtggagatgggtggggagctgggccaggggcctggctgggtggcctgttgggaactggggagccagctgcctgtgcaggtgcaaaatgggtggcagaagtggggtgcacaccccagaccagacaccagggcagaaacggcacaggaccaaggagatggggtggggaagggccgctctgggcccagcctgctctcccccaagcaagccactgctcgtgcaaagaaagcatgtgtctcctgcagatcttcctcctgaggccccatcttgtgcattcccccaacccagccccactggcgaggaccctgagtgccccgagtgaggctagacagcgggtggggctgtcctcgcttccctggggggcgtggggcactggtggcccttcacagactgatgcttaaggagcctcacatcagtgacacactgccccatccctccctggtggtcagcgacactgagtggctctgtgatcctccactgggcttgggacacccaccctcacggcctccccacctggtgctcgctcacctgcagctctcccagaaactggacactgctgttagcagccggactaggagcacgaggggcacagcccccatgcctggctaggtagggccgctggaccctggacacggattggaaggaaccagcactagcagaagcctgaggtgtgaaagggcagagaatgttccaggaacaatgggagtcagggcacacaggactttgggcaggtgaggatgaggttagacctgtcttctggagctgggctcaggggctcatgcctgtaacccttgcactttgggaggctacggcaggaggagcgcttgaggccaggagagttcgagaccagcctgggcaacatggcaaaagaaaaaatatatatatatattttagatggagtcttgctctgtcaccaggctggagtgcagtggcacgatcacggctcactgcaacctccacctcttgggttcaagcgattaccctgccttagcctcctgagtagctgggactacaggcgcgcgctgccacacccggctagttttttgtagtttagtagagatggggtttcaccacattggccaggatggtctcaatatcctgacttcgtgatccgcccgcctcggcctcccaaagtgctgggattacaggcgtgagccactgcgtccggccgtattc

SEQ ID NO: 114849 - DNA, 1457 bp, Homo sapiens
  Payload ID: 2437
  Gene Symbol: COMT
  Gene Name: catechol-O-methyltransferase
  Uniprot ID: P21964
  ENST ID: ENST00000407537
  CDS Start-End: 380-1195
ccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaat

SEQ ID NO: 114850 - DNA, 1339 bp, Homo sapiens
  Payload ID: 2437
  Gene Symbol: COMT
  Gene Name: catechol-O-methyltransferase
  Uniprot ID: P21964
  ENST ID: ENST00000406520
  CDS Start-End: 244-1059
cccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtgaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaagaatctaaa

SEQ ID NO: 114851 - DNA, 1548 bp, Homo sapiens
  Payload ID: 2437
  Gene Symbol: COMT
  Gene Name: catechol-O-methyltransferase
  Uniprot ID: P21964
  ENST ID: ENST00000403710
  CDS Start-End: 511-1326
atccccgcagcgccaccgccattgccgccatcgtcgtggggcttctggggcagctagggctgcccgccgcgctgcctgcgccggaccggggcgggtccagtcccgggcgggccgtcgcgggagagaaataacatctgctttgctgccgagctcagaggagaccccagacccctcccgcagccagagggctggagcctgctcagaggtgctttgaagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctata

SEQ ID NO: 114852 - DNA, 724 bp, Homo sapiens
  Payload ID: 2437
  Gene Symbol: COMT
  Gene Name: catechol-O-methyltransferase
  ENST ID: ENST00000428707
  CDS Start-End: 1-457
caaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggtgcagtggtctggtgtctttcagtccgctgacgtcttctgtatccctgatgaccagattgggctcctgagtcccctggcgcaacccgagaagtccaggagcccaggcccctcactcatgcattccctggcccagactggaaggcagccgccctgctcaaggcctaggccattgtcctcctcccgggtggcgctttgttctacgtcttttcagctgacattgctaggacatttttttttttttctaaatgaaaacacatcatgattcatggtggtacttcctgctcaactccggaccttggggctgtcccctgacctcactgaccttgcagccgtgtggtgtccatactgtcacatgaaagccccctgctttctctgcagcatacaggctggaaacgaccgccacccaccaccaggacagctgcaagccctgtgggactctccaggcccatcccagaggcatgtggggtcggataccagtgtttcaaggcacctgcctgcaaattgattttattatactttagatgtttga

SEQ ID NO: 114853 - DNA, 871 bp, Homo sapiens
  Payload ID: 2437
  Gene Symbol: COMT
  Gene Name: catechol-O-methyltransferase
  ENST ID: ENST00000412786
  CDS Start-End: 203-871
acgggaggagcaagaacacagaacagagggggcaagacagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgc

SEQ ID NO: 114854 - DNA, 1035 bp, Homo sapiens
  Payload ID: 2437
  Gene Symbol: COMT
  Gene Name: catechol-O-methyltransferase
  Uniprot ID: P21964
  ENST ID: ENST00000449653
  CDS Start-End: 108-773
gcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaat

SEQ ID NO: 114855 - DNA, 976 bp, Homo sapiens
  Payload ID: 2438
  Gene Symbol: COMTD1
  Gene Name: catechol-O-methyltransferase domain containing 1
  Uniprot ID: Q86VU5
  ENST ID: ENST00000372538
  CDS Start-End: 84-872
gcgggcccgcgagtccgagacctgtcccaggagctccagctcacgtgacctgtcactgcctcccgccgcctcctgcccgcgccatgacccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacacacgacc

SEQ ID NO: 114856 - DNA, 871 bp, Homo sapiens
  Payload ID: 2438
  Gene Symbol: COMTD1
  Gene Name: catechol-O-methyltransferase domain containing 1
  ENST ID: ENST00000469299
  CDS Start-End: 1-782
acccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgagctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtgggg

SEQ ID NO: 114857 - DNA, 3756 bp, Homo sapiens
  Payload ID: 2439
  Gene Symbol: CTNNA1
  Gene Name: catenin (cadherin-associated protein), alpha 1, 102kDa
  Uniprot ID: P35221
  ENST ID: ENST00000302763
  CDS Start-End: 91-2811
tcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 114858 - DNA, 3536 bp, Homo sapiens
  Payload ID: 2439
  Gene Symbol: CTNNA1
  Gene Name: catenin (cadherin-associated protein), alpha 1, 102kDa
  ENST ID: ENST00000518825
  CDS Start-End: 3-2528
aaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctgggaactgtgacacctgcggggcactgcaagggctgaaaggctggcctcctcccctttgctggccactcactgggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcag

SEQ ID NO: 114859 - DNA, 577 bp, Homo sapiens
  Payload ID: 2439
  Gene Symbol: CTNNA1
  Gene Name: catenin (cadherin-associated protein), alpha 1, 102kDa
  ENST ID: ENST00000523298
  CDS Start-End: 247-577
cttttgtttgggttttccagaagctttactgttataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggccc

SEQ ID NO: 114860 - DNA, 483 bp, Homo sapiens
  Payload ID: 2439
  Gene Symbol: CTNNA1
  Gene Name: catenin (cadherin-associated protein), alpha 1, 102kDa
  ENST ID: ENST00000524127
  CDS Start-End: 202-483
agttccaggcagagggaacagccaaggcaagagcactgaggataccccaaaccaagacagatgtctcacaaaacacaagcagagatgtcagtcttcaggcctcgcatggagaagatgaaagagaggggtggcttttccaaagcccagcgtcagcacgaagcttccacgagatgattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgta

SEQ ID NO: 114861 - DNA, 589 bp, Homo sapiens
  Payload ID: 2439
  Gene Symbol: CTNNA1
  Gene Name: catenin (cadherin-associated protein), alpha 1, 102kDa
  ENST ID: ENST00000519634
  CDS Start-End: 438-589
ataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagttggagtgcagtggcgtaacctcccaggctccattgatctccctccttagcctcccagatagctgggactacagatggcccaaggggctatacaaagaaagctgtttgcacaggatagaattaagagcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgccca

SEQ ID NO: 114862 - DNA, 868 bp, Homo sapiens
  Payload ID: 2439
  Gene Symbol: CTNNA1
  Gene Name: catenin (cadherin-associated protein), alpha 1, 102kDa
  ENST ID: ENST00000520339
  CDS Start-End: 566-868
ccatttcctcctcctagccggactggagggagacaaagcagcgcccgtctgcttcgggcctctggaatttagcgctcgcccagctagccgcaggaagaatgaagaatgagtgtaggagttacctatagtttctgcctaattatttaccaatctggacttttgaacaaacattttttttaaagacggggtctccgtcgcccgggctggagcgcagtgacacgatcatgactcactgcggcttctgtctcctgggctcaagtgatccccccacctcggcttccgaagtagttgggactacaggcacgcgccaccacatccgtctaatttttgtatttttggtagagatggtgtctcgctgtcttgcccaagctggtctcgaactcctgggctcaagtggtcctcctgcctcagcctcccaaagtgttgtgattacaggcctgagccagggtgcctgaccccatctggatatttattcagcgaaagaataattttttaatccacctaagagctcacagtgtaataggggagacacacaccccaggtgtagtacagagcggactgcaaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggt

SEQ ID NO: 114863 - DNA, 696 bp, Homo sapiens
  Payload ID: 2439
  Gene Symbol: CTNNA1
  Gene Name: catenin (cadherin-associated protein), alpha 1, 102kDa
  ENST ID: ENST00000517980
  CDS Start-End: 344-696
aggagggggttgggcagtcgctggcgctgccgctggtggtccctgtgcttgaagtgccggtggtatcggagtccatgcacccaaggcccagcacccagcaacattctctggcccagcagagggggttattgtgaagatcaaatgacacattccctttggaaactcttaaaggctttacaaaggataccccaaaccaagacagatgtctcacaaaacacaagcagagatgtcagtcttcaggcctcgcatggagaagatgaaagagaggggtggcttttccaaagcccagcgtcagcacgaagcttccacgagatgattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttc

SEQ ID NO: 114864 - DNA, 544 bp, Homo sapiens
  Payload ID: 2439
  Gene Symbol: CTNNA1
  Gene Name: catenin (cadherin-associated protein), alpha 1, 102kDa
  ENST ID: ENST00000521368
  CDS Start-End: 1-67
tgttcgaatgtctgcaagccagttagaagccctctgtcctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcga

SEQ ID NO: 114865 - DNA, 390 bp, Homo sapiens
  Payload ID: 2439
  Gene Symbol: CTNNA1
  Gene Name: catenin (cadherin-associated protein), alpha 1, 102kDa
  ENST ID: ENST00000520522
  CDS Start-End: 239-390
gtctcactgtgttgcccaggttggagtgcagtggcgtaacctcccaggctccattgatctccctccttagcctcccagatagctgggactacagcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgccca

SEQ ID NO: 114866 - DNA, 562 bp, Homo sapiens
  Payload ID: 2439
  Gene Symbol: CTNNA1
  Gene Name: catenin (cadherin-associated protein), alpha 1, 102kDa
  ENST ID: ENST00000519116
  CDS Start-End: 288-562
gtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttggcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcc

SEQ ID NO: 114867 - DNA, 560 bp, Homo sapiens
  Payload ID: 2439
  Gene Symbol: CTNNA1
  Gene Name: catenin (cadherin-associated protein), alpha 1, 102kDa
  ENST ID: ENST00000519768
  CDS Start-End: 500-560
agcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttagcagagtgatgatttttaatgcttgtgagagccagtgttagactgccgattctgcatagagagatcatctaaatgggcagaagcctgcacaatttatgaagtgctgatttaacaccagcctatgcaagatggcccaaggggctatacaaagaaagctgtttgcacaggatagaattaagagcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgttt

SEQ ID NO: 114868 - DNA, 536 bp, Homo sapiens
  Payload ID: 2439
  Gene Symbol: CTNNA1
  Gene Name: catenin (cadherin-associated protein), alpha 1, 102kDa
  ENST ID: ENST00000523275
  CDS Start-End: 1-390
aagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcaga

SEQ ID NO: 114869 - DNA, 719 bp, Homo sapiens
  Payload ID: 2439
  Gene Symbol: CTNNA1
  Gene Name: catenin (cadherin-associated protein), alpha 1, 102kDa
  ENST ID: ENST00000520158
  CDS Start-End: 73-719
ggcggcggttggcccagttccaaggttgactccctcttacgtcctcttgcatcttggtgacatttttttgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaa

SEQ ID NO: 114870 - DNA, 710 bp, Homo sapiens
  Payload ID: 2439
  Gene Symbol: CTNNA1
  Gene Name: catenin (cadherin-associated protein), alpha 1, 102kDa
  ENST ID: ENST00000520260
  CDS Start-End: 615-710
gcagagaagagctcctggagcagcatgagtgcatttactgaaaagcttttccgagaaacggcacaagaatggatttgcttatgtgctgcgaccacacagaactgtatataggctgacgtcaccggatgacgtgtcttttgtttgggttttccagaagctttactgttataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttagcagagtgatgatttttaatgcttgtgagagccagtgttagactgccgattctgcatagagagatcatctaaatgggcagaagcctgcacaatttatgaagtgctgatttaacaccagcctatgcaagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttg

SEQ ID NO: 114871 - DNA, 642 bp, Homo sapiens
  Payload ID: 2439
  Gene Symbol: CTNNA1
  Gene Name: catenin (cadherin-associated protein), alpha 1, 102kDa
  ENST ID: ENST00000522227
  CDS Start-End: 274-642
gggcagtcgctggcgctgccgctggtggtccctgtgcttgaagtgccggtggtatcggagtccatgcacccaaggcccagcacccagcaacattctctggcccagcagaggggataccccaaaccaagacagatgtctcacaaaacacaagcagagatgtcagtcttcaggcctcgcatggagaagatgaaagagaggggtggcttttccaaagcccagcgtcagcacgaagcttccacgagatgattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaac

SEQ ID NO: 114872 - DNA, 487 bp, Homo sapiens
  Payload ID: 2439
  Gene Symbol: CTNNA1
  Gene Name: catenin (cadherin-associated protein), alpha 1, 102kDa
  ENST ID: ENST00000518381
  CDS Start-End: 263-487
gtactgggatagtccgcagggagttggaacgtaaatgcaaggtctgcagcttccgaaggccatagaagagctctgggtgcagagatgacagctgattaaaagacaggtccaaattttgcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaa

SEQ ID NO: 114873 - DNA, 484 bp, Homo sapiens
  Payload ID: 2439
  Gene Symbol: CTNNA1
  Gene Name: catenin (cadherin-associated protein), alpha 1, 102kDa
  ENST ID: ENST00000520520
  CDS Start-End: 1-411
atgacagactttacccgaggtaaaggaccactcaaaaatacatcggatgtcatcagtgctgccaagaaaattgctgaggcaggatccaggatggacaagcttggccgcaccattgcagaccatgtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatt

SEQ ID NO: 114874 - DNA, 859 bp, Homo sapiens
  Payload ID: 2439
  Gene Symbol: CTNNA1
  Gene Name: catenin (cadherin-associated protein), alpha 1, 102kDa
  ENST ID: ENST00000519113
  CDS Start-End: 441-859
ccccgggcgggcgtgggacccgcgtcgggccggcggtcccttcccccgcagggcccgagtatggggcccgggcgggcacggccggcgcttcccagcgctcgggaagtcggggggccgcctgggctggggaggagaaactataggcccagcgccgccgccgcgtttcctcttggaaaagttttctcgcggtttccaaactttgttaccgcggcctcggcgcgcgcggcagccccgcgccgggcccctcggccgccttccttccctggggcggcttgtctgggagccgctttcccgggaagtgattgtcgtccggctccgaggcgttcctgccccctcccccttcccggccgctgagacttcccgatggggcggcggggacgcgggctcggcgaaccgggaggctggagcccgggcttctcccatacagcttcgccgtagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgat

SEQ ID NO: 114875 - DNA, 554 bp, Homo sapiens
  Payload ID: 2439
  Gene Symbol: CTNNA1
  Gene Name: catenin (cadherin-associated protein), alpha 1, 102kDa
  ENST ID: ENST00000517656
  CDS Start-End: 437-554
accatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttggagtgcagtggcgtaacctcccaggctccattgatctccctccttagcctcccagatagctgggactacagatggcccaaggggctatacaaagaaagctgtttgcacaggatagaattaagagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaaga

SEQ ID NO: 114876 - DNA, 694 bp, Homo sapiens
  Payload ID: 2439
  Gene Symbol: CTNNA1
  Gene Name: catenin (cadherin-associated protein), alpha 1, 102kDa
  ENST ID: ENST00000523685
  CDS Start-End: 310-694
ataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacacagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctca

SEQ ID NO: 114877 - DNA, 545 bp, Homo sapiens
  Payload ID: 2439
  Gene Symbol: CTNNA1
  Gene Name: catenin (cadherin-associated protein), alpha 1, 102kDa
  ENST ID: ENST00000523912
  CDS Start-End: 78-545
accgctcctcctccctctcaggggtcactcccggcctaagctcccactaggggccggggaggaaggaattctgagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagtt

SEQ ID NO: 114878 - DNA, 874 bp, Homo sapiens
  Payload ID: 2439
  Gene Symbol: CTNNA1
  Gene Name: catenin (cadherin-associated protein), alpha 1, 102kDa
  ENST ID: ENST00000522013
  CDS Start-End: 558-874
ggtcttaacttgttgatggcagatgggtggcttgttgcagagaagagctcctggagcagcatgagtgcatttactgaaaagcttttccgagaaacggcacaagaatggatttgcttatgtgctgcgaccacacagaactgtatataggctgacgtcaccggatgacgtgtcttttgtttgggttttccagaagctttactgttataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttagcagagtgatgatttttaatgcttgtgagagccagtgttagactgccgattctgcatagagagatcatctaaatgggcagaagcctgcacaatttatgaagtgctgatttaacaccagcctatgcaaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccaca

SEQ ID NO: 114879 - DNA, 568 bp, Homo sapiens
  Payload ID: 2439
  Gene Symbol: CTNNA1
  Gene Name: catenin (cadherin-associated protein), alpha 1, 102kDa
  ENST ID: ENST00000521640
  CDS Start-End: 447-568
atgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtctcactgtgttgcccaggttggagtgcagtggcgtaacctcccaggctccattgatctccctccttagcctcccagatagctgggactacagatggcccaaggggctatacaaagaaagctgtttgcacaggatagaattaagagcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatgg

SEQ ID NO: 114880 - DNA, 572 bp, Homo sapiens
  Payload ID: 2439
  Gene Symbol: CTNNA1
  Gene Name: catenin (cadherin-associated protein), alpha 1, 102kDa
  ENST ID: ENST00000518910
  CDS Start-End: 89-572
ctagccggactggagggagacaaagcagcgcccgtctgcttcgggcctctggaatttagcgctcgcccagctagccgcaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcag

SEQ ID NO: 114881 - DNA, 869 bp, Homo sapiens
  Payload ID: 2439
  Gene Symbol: CTNNA1
  Gene Name: catenin (cadherin-associated protein), alpha 1, 102kDa
  ENST ID: ENST00000519309
  CDS Start-End: 68-235
ggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacagatacttcacctttcttcagaggggaaacccaagaaaggtggagtctggatccttgattgttaaggtctctcactctgcttaacacacctttcattgtgtgggattaattagcaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctac

SEQ ID NO: 114882 - DNA, 557 bp, Homo sapiens
  Payload ID: 2439
  Gene Symbol: CTNNA1
  Gene Name: catenin (cadherin-associated protein), alpha 1, 102kDa
  ENST ID: ENST00000520865
  CDS Start-End: 448-557
tataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttggagtgcagtggcgtaacctcccaggctccattgatctccctccttagcctcccagatagctgggactacagatggcccaaggggctatacaaagaaagctgtttgcacaggatagaattaagagcagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagc

SEQ ID NO: 114883 - DNA, 565 bp, Homo sapiens
  Payload ID: 2439
  Gene Symbol: CTNNA1
  Gene Name: catenin (cadherin-associated protein), alpha 1, 102kDa
  ENST ID: ENST00000521683
  CDS Start-End: 353-565
accatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacaatggcccaaggggctatacaaagaaagctgtttgcacaggatagaattaagagcatgtcagcattccgtctgcagttgagatgttgattcctccttgtattgcacattgctgaaaggggcttcctgaggctggagagagcagtgaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctca

SEQ ID NO: 114884 - DNA, 2741 bp, Homo sapiens
  Payload ID: 2439
  Gene Symbol: CTNNA1
  Gene Name: catenin (cadherin-associated protein), alpha 1, 102kDa
  ENST ID: ENST00000521724
  CDS Start-End: 93-206
tttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaa

SEQ ID NO: 114885 - DNA, 579 bp, Homo sapiens
  Payload ID: 2439
  Gene Symbol: CTNNA1
  Gene Name: catenin (cadherin-associated protein), alpha 1, 102kDa
  ENST ID: ENST00000517533
  CDS Start-End: 223-579
ataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaa

SEQ ID NO: 114886 - DNA, 2684 bp, Homo sapiens
  Payload ID: 2439
  Gene Symbol: CTNNA1
  Gene Name: catenin (cadherin-associated protein), alpha 1, 102kDa
  Uniprot ID: P35221
  ENST ID: ENST00000540387
  CDS Start-End: 135-1745
ctgccgattctgcatagagagatcatctaaatgggcagaagcctgcacaatttatgaagtgctgatttaacaccagcctatgcaaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaacc

SEQ ID NO: 114887 - DNA, 579 bp, Homo sapiens
  Payload ID: 2439
  Gene Symbol: CTNNA1
  Gene Name: catenin (cadherin-associated protein), alpha 1, 102kDa
  ENST ID: ENST00000522052
  CDS Start-End: 159-353
aataaagcgagaaagaagaactcctgacttaaaaacatgatattccttcagtgtaggaagcagcagtgaggttgtaataaaggctgcattcaagaagacccatctgaacagctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgagggaatctgatcccatctcttcacaccagagttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgc

SEQ ID NO: 114888 - DNA, 3831 bp, Homo sapiens
  Payload ID: 2439
  Gene Symbol: CTNNA1
  Gene Name: catenin (cadherin-associated protein), alpha 1, 102kDa
  ENST ID: ENST00000627109
  CDS Start-End: 96-2621
ccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctgggaactgtgacacctgcggggcactgcaagggctgaaaggctggcctcctcccctttgctggccactcactgggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgac

SEQ ID NO: 114889 - DNA, 2927 bp, Homo sapiens
  Payload ID: 2440
  Gene Symbol: CTNNA2
  Gene Name: catenin (cadherin-associated protein), alpha 2
  Uniprot ID: P26232
  ENST ID: ENST00000343114
  CDS Start-End: 184-1938
agaagcagagttagataaaatgtggtgcctaccctgtgtgttcacagttctggagtggagatgatgagtaacaaaccaatattattcatgctatggcagagatgtaaacaagagctgtggttgaagagatttttctagctaattgagcaagaccaggtagaggaaggaagacgaattgaccagatggatggatggagaaggccactccagtcagtaggcaaagtctgtgaaaaaaatatgaagacttctgagatgcataccatgtctggagcacagactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcatt

SEQ ID NO: 114890 - DNA, 3071 bp, Homo sapiens
  Payload ID: 2440
  Gene Symbol: CTNNA2
  Gene Name: catenin (cadherin-associated protein), alpha 2
  ENST ID: ENST00000361291
  CDS Start-End: 373-2082
agaagcagagttagataaaatgtggtgcctaccctgtgtgttcacagttctggagtggagatgatgagtaacaaaccaatattattcatgctatggcagagatgtaaacaagagctgtggttgaagagatttttctagctaattgagcaagaccaggtagaggaaggaagacgaattgaccagatggatggatggagaaggccactccagtcagtaggcaaagtctgtgaaaaaaatatgaagacttctgagatgcataccatgtctggagcacagactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggacaggagttcagagcactttcactaccttttatgaggtagattgtgatgtcatagatgggggcagggctagtcaactttctacccacctcccaacctgtgctgagggagctccgatcgggagtggaagcagtgattcctccatgctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcatt

SEQ ID NO: 114891 - DNA, 3684 bp, Homo sapiens
  Payload ID: 2440
  Gene Symbol: CTNNA2
  Gene Name: catenin (cadherin-associated protein), alpha 2
  Uniprot ID: P26232
  ENST ID: ENST00000402739
  CDS Start-End: 6-2867
ggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggacaggagttcagagcactttcactaccttttatgaggtagattgtgatgtcatagatgggggcagggctagtcaactttctacccacctcccaacctgtgctgagggagctccgatcgggagtggaagcagtgattcctccatgctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagtta

SEQ ID NO: 114892 - DNA, 595 bp, Homo sapiens
  Payload ID: 2440
  Gene Symbol: CTNNA2
  Gene Name: catenin (cadherin-associated protein), alpha 2
  ENST ID: ENST00000409550
  CDS Start-End: 25-595
aactccttctttgctctgtcctgaatgaggaagctgcattggaacctttcatgtggtgacttcaagttgtgtgagactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtga

SEQ ID NO: 114893 - DNA, 541 bp, Homo sapiens
  Payload ID: 2440
  Gene Symbol: CTNNA2
  Gene Name: catenin (cadherin-associated protein), alpha 2
  ENST ID: ENST00000409971
  CDS Start-End: 190-541
tttttacatggcgggacagccatgcctcagaatgtttagcatatttatcatctcagaagggtccaacagtatttagtgtgaatgagacactgttcagattggaaatacactgtctatactgtactccagacacacctattttgcttttaaaattattctcaatatctgtcttttccatagtaacggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcgg

SEQ ID NO: 114894 - DNA, 432 bp, Homo sapiens
  Payload ID: 2440
  Gene Symbol: CTNNA2
  Gene Name: catenin (cadherin-associated protein), alpha 2
  ENST ID: ENST00000409266
  CDS Start-End: 165-299
gttctaagtattctagtgtgaaagagaatgagccgaacaattaaagtagagtgagatttatggcacagtcgagggaagcattatgtcctcttaagatcgagggtgacactgaacaggtcaagaagtgatgcctgagttgagtctcaaaacataaccaaaggagcatgacttcggcaacttcacctatcattctgaaatgggaccccaaaagtttggaaatccggacgctaacagtggaaaggctgttggagccacttgttacacagtgcatttttttttccaccggatatttcaaatgaaaatcacataaatctgtattgctgactgtcatcttgaaaaaggatacctgttgaattgggtaactcttttcatgaaaataacttaaaaaactggatgaaatataaaagcatcttttgaatgtattgtgacttt

SEQ ID NO: 114895 - DNA, 521 bp, Homo sapiens
  Payload ID: 2440
  Gene Symbol: CTNNA2
  Gene Name: catenin (cadherin-associated protein), alpha 2
  ENST ID: ENST00000451966
  CDS Start-End: 323-521
gacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagctagtcaaaggaagcgtttcattccacctatctttggtcagaggagagggaggagtgtagaccagcattctacccactgacgacaggtcatctgtctctattattgaagaaccattgcagagcctatgctcaccttctgcgagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaag

SEQ ID NO: 114896 - DNA, 4349 bp, Homo sapiens
  Payload ID: 2440
  Gene Symbol: CTNNA2
  Gene Name: catenin (cadherin-associated protein), alpha 2
  Uniprot ID: P26232
  ENST ID: ENST00000466387
  CDS Start-End: 725-3442
gctgaaggaagctacaatcatccaagtgggaagtaatgtctaccgatgttctgatttaagtgaatgaaggtcttctttccacctcgggaaatcttgagggttatgtaacagcagctttgaaaggcttgtgagatgtactttgtgctagtccatctcaaatcttcaccggctgtaccaagaacagaaaaaaaaaggaatttgagacgggatctcagcatgtttgccaggatggtctcagtctcttgacctcgtgatccgcctaccttggcctcccaaagtgttggaattacaggtgtgagccactgcgcccagccatcagaacaaaatatacagctggatgtttgtcacaattctaatgtccctgcaaagatgagatgcatgaatcacacagcaatctcatcaaaaagataagaaaattgagactcagagcatttaagcagccagcctggagtcacagagatttaagtctcagagccagcactcaggatgagtgccaatggaagcctgtccttggagtccagaatgaacgtcagaagcaacccagccacagcaggagactgtccatgaatgtcatctggctgaacctaaagcacctctggatttagatgcactccttcaaggaccatgggttctgcaacagtaccccctctccattgttccagctctgactcagatgggccctccttgatggcactcccagcagcacagccttagcactgggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttg

SEQ ID NO: 114897 - DNA, 3839 bp, Homo sapiens
  Payload ID: 2440
  Gene Symbol: CTNNA2
  Gene Name: catenin (cadherin-associated protein), alpha 2
  Uniprot ID: P26232
  ENST ID: ENST00000496558
  CDS Start-End: 214-2931
gagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttga

SEQ ID NO: 114898 - DNA, 2792 bp, Homo sapiens
  Payload ID: 2440
  Gene Symbol: CTNNA2
  Gene Name: catenin (cadherin-associated protein), alpha 2
  ENST ID: ENST00000540488
  CDS Start-End: 373-1803
agaagcagagttagataaaatgtggtgcctaccctgtgtgttcacagttctggagtggagatgatgagtaacaaaccaatattattcatgctatggcagagatgtaaacaagagctgtggttgaagagatttttctagctaattgagcaagaccaggtagaggaaggaagacgaattgaccagatggatggatggagaaggccactccagtcagtaggcaaagtctgtgaaaaaaatatgaagacttctgagatgcataccatgtctggagcacagactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcatt

SEQ ID NO: 114899 - DNA, 2870 bp, Homo sapiens
  Payload ID: 2440
  Gene Symbol: CTNNA2
  Gene Name: catenin (cadherin-associated protein), alpha 2
  Uniprot ID: P26232
  ENST ID: ENST00000541047
  CDS Start-End: 268-1881
ggacctttgctttagaaaagcaacttgagagaagacacaggaaggcaatgatttggggcttggctaagatttttggggttttttccccctcttgcgggtactggaattctgcagtcagccagcccttttttgaggtggagaggggaaatgctttccaaacccacctagtttgggaagccatccaagtcccggtggtgtgagatccagtgtggcaaaaagactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagtgtcctgattcagcatgtaagcaggatttattagcctaccttcaacgaattgccttgtattgccatcagcttaatatctgcagcaaggtgaaggcagaagtgcagaatctgggaggagagctcattgtgtcagggctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcatt

SEQ ID NO: 114900 - DNA, 3167 bp, Homo sapiens
  Payload ID: 2440
  Gene Symbol: CTNNA2
  Gene Name: catenin (cadherin-associated protein), alpha 2
  Uniprot ID: P26232
  ENST ID: ENST00000629316
  CDS Start-End: 79-2661
gtgattaccactccagctgctgggaacgggcgagaaagaggaggaggcgagaaactcccaccgacccacagagggagcatgacttcggcaacttcacctatcattctgaaatgggaccccaaaagtttggaaatccggacgctaacagtggaaaggctgttggagccacttgttacacaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtggaagaggccctggaagctgtcaaaaatgctacaaatgagcaagaccttgcaaaccgttttaaagagtttgggaaagagatggtgaaacttaactatgtagcagcaagaagacaacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacaataagattatcctggaccccatgacgttcagcgaggccaggttccggccgtccctggaggagaggctggagagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatactggaaggaaagaaaaaggagatcctctcaacattgcgattgataagatgactaagaaaacaagagatctaaggagacagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggttgccaatttggcctgttccatctccaacaatgaagaaggggtgaaattagttcggatggcagccacccagattgacagcctgtgtccccaggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcaggaccccagaagaactagaggatgattctgactttgagcaggaagattatgatgtgcgtagcaggacaagtgttcagactgaggatgaccagctcattgcagggcagagcgcacgggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaagaggcaaaggcccattgaaaaatacatctgatgtcattaatgctgccaagaaaattgccgaagcaggttctcgaatggacaaattagctcgtgctgtggctgatcagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccg

SEQ ID NO: 114901 - DNA, 696 bp, Homo sapiens
  Payload ID: 2441
  Gene Symbol: CTNNA3
  Gene Name: catenin (cadherin-associated protein), alpha 3
  ENST ID: ENST00000330298
  CDS Start-End: 118-696
atcataagccaaattgtgagccatgatagtggcactgaatttctaaatacaagaaattgcttagacaattggtttagtatctgtatatgggcaatactctgtcctgcagtaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcag

SEQ ID NO: 114902 - DNA, 10675 bp, Homo sapiens
  Payload ID: 2441
  Gene Symbol: CTNNA3
  Gene Name: catenin (cadherin-associated protein), alpha 3
  Uniprot ID: Q9UI47
  ENST ID: ENST00000433211
  CDS Start-End: 176-2863
caacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagcatgtcagctgaaacaccaatcacattgaatatcgatcctcaggatctgcaggtccaaacattcaccgtggagaagctactggagcctctcataatccaggttaccacacttgtaaactgtccccagaacccttccagcaggaaaaaaggacgttcgaaaagagccagtgtccttctagcttctgtggaggaagcaacttggaatttattagacaagggagagaagattgcccaggaagctacagttttaaaggatgagcttacggcttcacttgaggaagttcgcaaagaaagtgaagctctgaaagtatcagctgagagatttacagatgacccctgttttctcccaaaaagggaggctgtggttcaagctgcccgtgccttgctggctgcggtgacgagactccttatccttgcggacatgattgatgtcatgtgcctcttgcaacatgtgtcagcttttcaaaggacatttgagtctctcaaaaatgttgccaacaaatctgacctccagaaaacctaccagaagcttgggaaggagctggaaaatttggattatttagccttcaaacgtcagcaggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtggcaaatcttgcttgttccatgtcaacaaatgaagatggaattaaaattgtcaaaattgcagccaatcatttggaaaccttgtgtccacagattattaatgctgcacttgctttggctgcaagacccaaaagtcaagcggtcaaaaacaccatggaaatgtacaagcgtacatgggagaatcatatacatgtcctcactgaagccgtagatgacattacaagcattgatgacttccttgctgtatctgaaagccatatcttggaagatgtcaacaagtgtatcatagccttaagagaccaggatgctgataatttagaccgtgctgcgggtgctatcagaggccgggcagcaagagttgctcacatcgtcacgggtgaaatggacagttacgagccaggggcttacacggaaggtgtaatgagaaatgttaacttccttacaagtactgtaattcctgaatttgtaacacaagtgaatgttgccttggaagccttaagcaaaagctcattgaatgtgttggatgataatcaatttgtggacatctcaaagaagatctatgatacaattcatgatatcagatgttcagtcatgatgattcggaccccagaggaactggaggatgtttctgaccttgaagaggaacacgaggtccgcagtcacaccagcattcagaccgaagggaaaactgatagggctaagatgactcaactgcctgaggcagaaaaagaaaagattgctgagcaagttgctgatttcaagaaagtaaagagtaagctggatgctgagattgagatatgggatgatacaagcaacgacatcattgttctggccaagaacatgtgtatgatcatgatggagatgacagacttcactaggggcaaaggaccactaaagcatacaactgatgtgatctatgcagcgaaaatgatatcagaatcaggatcaaggatggatgtccttgctcggcagattgctaatcagtgcccagatccatcttgtaaacaggacttgttggcctacctggaacagattaagttctactcccaccaactgaaaatctgcagtcaagttaaagctgagatccagaacctgggaggagagctcatcatgtcagctttggacagtgtcacatccctgatccaagcagccaaaaatttaatgaatgctgtagtgcaaacagtgaaaatgtcttacattgcctcaaccaagatcatccgaatccagagtcctgctgggccccggcacccagttgtgatgtggagaatgaaggctcctgcaaaaaaacccttgattaaaagagagaagccagaggaaacgtgtgcagctgtcagacgaggctcagcaaagaaaaaaatccatccattgcaagtcatgagtgaatttagaggaagacaaatctactgaaaccactattctacatatagtgcctatatgacaaaatcctgcctaaccacactgctttattttacacttaagaagttctgtaatttcactaagttttggtgtttaactcacaaataacataaaatattgggcgctaaatcaacaaaagcaatatatatttgggatcatatcactgtcatttctgtatggtcagcacctaatagttaaggaatatttgcttgttgaatgaatgaaattatcacgtgtcattcagcgtttcccatcatagagattatctactattcgttaccaaataaacacaggagaggccagagagtcctgtttatctgtaatacttcatgtacacttatcatccttatcttgaattaaaacactaacatgagctcctaacttggttttttaatagaaacaaaagacttttataaaatattttcccatttaatctccatgctttctttatctgatctaacctggcacctaaccaggcagaaatgtatgattcctgccatagcaaaaaaaccaccttttaatctctagatagctgtactcattgtcaacttattaggctaatatccattataaactaatcaaatttgaatagttaggctacttgctggattttgaaggtcaaccttgtttattaataaaatgctttcttaacattataaaggttacaatgagttctgatgccacatactcaccttttgggtttccaatgtgttagagagttctgtacttttgagtgttaggcctatccgaatacatatgtgaaagaagagttatcacccattgggaaaatgagacaacaaactatatcccaaagtgagttatattaataataacagaagtgtaagttctgtatgaccctatttttacaaacataaaaatacatttttatcagcttgcaattgtaattaaaaggaaaatggcagtttgaaaaatcttttgacgttgagtaaaatataactgcatgaactgtaccattgaactatgaagcagttaatggcaatgaagctggagtgattttaataacgttcttttaaataaaagtcactggggtcattttacaactccagtcactgtgttcattcctagttgagttcataatggacttcataatagtcttagagtctagtgtacctctctctgtcattctctctctctttttctctcccctgatgacctgcctctctctgtctttcaaaaatgtccttaacagaaactctttggaggccataagttttgttttcattttttctcattcatagagttctgattcacagactttaaaaaacattttctattctacattatcataatagtattatattgtacctttttacttctaaaacattgccattgatgagaggcgtctcagcaacgatgtaaccttagattgatgagaaaaaaatttacacatacaataccagttgatattaggagaaccagtttgggtaaaaggatgcatgaaacatagaaaagcataaagattgacagtacgatatgtgtggaatcttaagcataatggtatgggaaaagaaggatctatttaataggtcattattaattatgcaggaaatgttaaatttcttgtaatgaattatttcaatcttccaagtagctggattgcctgagctcagtgtaaaacttcctaggaggtgaaggcaataaactcctccctgttttgcaccatagactggcctacaataactattctgaacagaatgcactgcccagaagaaaaggcagtgaagaagggaattagggaattcagatgactctgtttttcagaattatctagatgattgaggcaaatagagattttcttttattgaaatgctgccatcattttctgctctaagtgtagatgttgcacgagtgacatctgtggtatatccttcttccagatagaagtataaatttataatttagtggggagaggaattttcttttaatcaccaaactaccagctgtatagaaaatttttttgaaatcaccaaactagcagttgtgtatcttagctcctaaagccacattcacaagaatcataagcatctcatttagaaaatctaatgtccaccggacccaacatcatctttccacatgttggagtttagaacatgcagtattggacaccaaaagaacagaaataacttgaaattatacaattaccaaataacctccatctctttgataaaaatgactttttacccaaagtgagatgtgaacaagttctcctctttaacccaggcagattttcagcttagctcaaagcaaactataattaaataaaacaataaaaattttaactcaatgaatatcctaggagttaatctgctgtggtaatcgatagtgacataaaaacaagatgcatagagctgaaaaaggcatctgtccacctgagtgaattcctgtagtaggcagcatttcaagatttagtttgattcaaacctgctgataaaacaaatgcttatatgcaagaaaaactagcagcaagatatgaataaatctccccattatgttaaaaactaatcagcatgacacatttatatttaggtatttcttctgcagaggattgccagaaatttcttaatgagagtgataatttggtgatccacctatgtaccttttgatgtctcatcacagagattagtgcttcctctgataatacatttgcttgatcctgctaataagaactcacctttctttttaacgaaatcaatttgtgttaatttacatagggaaaaacgttccttgagagggaggagaggggtgtttaccacccacaggagcagttccatccctggttacccaccagtatccctgccagatgttagactggaattagaatgaaaatttaaaaaaaaacgaaataataatccactaaatggccttctaattagagaaatttgaagatttctatcaaatataaaaagtgagaaatagaaatcattccctttaatttatgacaaattaaaattattgaagtaaaatgtttctaagtcagtttctggatagttcttgaatgagtcaagaaaaaactcaaacactaaatttctaagctaatttgttcattattcctttctgtttattatttattatatgagtgcaaattgcaaatgtattagaaaagacaatatagccttcacattcacaagtgtgccttctggcctttgaaatcttttaacataagatcaatataacatatttgttccccataaaaatctcttatgtacagggaataaggtcctccatagctacacagagacacccattcttgcagtctggcattcttaacacctttagcttcaaaggcagtcggtttcaatttcaagctaaaattgtgaatatacaattaagtgcgcaacttgggccttcagaccaaataattaatgctcctcaaattaaataatgagtggctgaaaagcctaatgtgtaacaacagagtaagtgacttcaacggcttcctgaaccttcattttgagggtgttctcatctcacccacctctgggctaggtatcctctgttaattgctaacaatttcctaccaaaatagtgcaatcaggactgcccatcacagcaaattactccaattaatgccctttcctcttctgtgaaccaaaaatatctctctcctgtctctcatctctatcccaggtataaattgactaataaattttacagagttttagtcaaaattatgaattttaatttccagcaacattattcctttagtctttctattccccaaaacattcttaaattttggtatcaaatgttcatttctgtcctagagattgtggttcccatggctacagatttttgtatagtggtagtatgagtggaataagatctgagacttttcctggtgatatccaccattctcttgtgaactcattgcagaataaacagcctctttcactttcattgtaagtagttctttaggttggcaaagcaggcaccagaatctgaatttgaatgaaatctgtactttcttttgttggcctattttttgccaagacagcctgcctattgtatatttaggaatcaaatattcattttttctgtttgtaaagccagaaatatttcagttaaaaagaatataattttatattattttaataattctttttaagtaaagtaggaaaatttctgccacctgagatgttactgtttttatttatatgaaaattccatttttttctttatgactcttttcccataccattatgatatgttcagcattagtattttccattttaccactaaacaaataagccaggactaataacaatagcagtttgagagtttttattttggcattttggttttaattaggaaagaaaacatggatgctattaaaactagttgtagttaaaaatgttttgaatgaggctactaacgctatcttagtcatctcaaagagaaagagaagaagtaaaattttaaatacctttttggcatttttaaccaattcatatgaacaaaaacatatattctattaaagcaaaataaagaatagtttaaaacactagtcttcttgcatgtgaatattttccccctaacagacaagatagaatccatttctggacactctaaaagaaagtaatgttaattgagagagctgtctccaaatggaactcaacctgaccagaatcccatccgcaggcaagagatgggctgtggggccgaccataagttttattctgagacgagatgctttatggctgctggctgcattatggcatctagcagtccccactggtttgtgggaacaaaacacatggattgatattcaatatgagtttggtaagttggagaaaaatggagacgatacggagtagtctaaaggcacaacaaataagaaggtgccagaggtagggaagggtctgagaggggtagttgcagaagcatttagctttcatagatgaggggagagttttttggttttatgaagattaggcagccctcctgaggaaagtattaaggatagaatgagacacttgtcttggtggtttggtgaagtcgtgtcgaaggcaaaaggatgaactacacatattttgagcatgatttagtaatattgtttgcaagttgagaaacagaaattcagccattctcctgactgatggtaggtgaaattcttcccaatattagagccaatctgggttaccatacgttcatatatttaacagctatttgttaaacaactgtgatgttccaggcactgttctaggttcttaggatacaccatataacaaaacaaatagtgatccttgccctcatgtgccagctctgtgttaaatgctaactattatcttattcaatcctccaaataaccctataggatatatatcattccacagacaaggaagctgagggttaaatgggataagaatcttgctcaaagtctcactggctttaaaatattaatatatattttacatcattcaagacagatatataattagctgaatattctcacctctattaactgaatgtagagtgtcaggtacatgggaagtaagttatttacgtgatctgaaataagaggacaacctttgccaaattacttttattaccatggagaagaaagcttcaatgaaatgcctgtttcagcccatcttcagtattggttggttaataccatttgttaacaccaatcctttcctcttttactgctaacatgtgactgtgtttaaaattatagattgcagcagagtgttggccaaggattattgtagtaggataaagtttccctgtatttgaaatttacccaaactgtagcaaatacatctttccttctttatggaggtcacacgtgtgcatagtatgtgcctgaatacaggtaaactttgtgttttaaaattacatggccttttttagagtcgactgaaggctagactcttcttgcccatgttgctggataggctttcaaatctcaggccttggagagttaaatgactttctgatatttcttacggtggagccacataagaaatacacacattcctagtttgagcaatggatgtgtatattggggatcttcacttttatgtatctggtagtcatgatggtgcctattcccaactgtaggaaaggaaagccctcaaggagaaaattctctttcaaaaaggctcagatttctaacaattatgtctaaatgtttcttcaatttagaacatgtacaaaagctacttaatattagcagagtagttcttgtgttttcatttcaaatgaaatattcccagttccaaagtttatttccttggcattttcaagaaggatggttatttttagttctggttatttggtgttggaggtctgtgacacttccttatacatttaaagccccctttgaatagttgtatcaatagttcaaaagcctgtagatatcttgcttttctattctgacagcccagcttctgcagactcaggccaaccttaggtatgtcacatcagttccccatctgtgtaaattacctgaacctctctgtggtattcactgagagttgagcttctactaagggatttccttgacctgggcttttaacaccagatttgtagtggagtgtttattagtaaagcaaaggagtaagtcagagatgctagcccctgctctcagttaaacagaactatcctccttcctgaatatttaaacataaaattaattttaaactactataaaaatcatgttccattgcttgccaaatcttataccattataatgctgtatttttacatgttagtatacattgtgtccatagggatataaatatgagaatttcagcaactgtcttgcagggttaagatgtgctatttgttgattttgcaaatttttctcatgtggtacagtccctccaaagaaaatttccttagacctaaatggtagcataataatttctcctccatatccgtgactaacaagttcctgaaaacagaagtagacatattttatgcccaatttagtacctaataattgaggcttaaaacaaaattttcttgggcaagttgggtgattaaatatgaattaaaacttctagagaaagatttccagatgcccctgttttccattttgattatggttttagtttcatagcaacttgggggaaaaaaatcatttactttatgtcgtattacaacaacaactttgacagcttaaatgtagtgacctctctgaaggtaatatgcacattataatttaggatgaaagcagatttaaactaagactttctgagatgaaataaaagtaaccaattcataatagtcatgtttattgcagcaatatcttgggaacttaagtttagtggcgtttgaggtgtttctgactatcttgcttgttcatttcaccctgctctgcagagacagaatatgattgaatgaactgcccattatattaatgaccagttcaaagcagttttgtgctttggctatagataaaatttggcaaaaatactgtaggcctttctggtccatatttatccttaaagtatttttgccaatcaataaaaatgaaatatttatccagaaatagaaaaagctctttcctatgacattgacatagaagcccaaatactccttgtttgagaccctgcatgtcttttgtgtttaactgaatcaatgattttttttagttgtgctcttaattgcattatttcacatatgtaacactgggtttgttttggttatatagtattattttactttattctaatttcaactcatgtcactctgtagctcattaagaatttgttcaactgaaaattaaaatgtgtgttaaagcaataaaaatgaaaagattggctatgcatttta

SEQ ID NO: 114903 - DNA, 555 bp, Homo sapiens
  Payload ID: 2441
  Gene Symbol: CTNNA3
  Gene Name: catenin (cadherin-associated protein), alpha 3
  ENST ID: ENST00000545309
  CDS Start-End: 1-555
caggacttaaaatctccaaatcagagagatgaaattgcaggagcccgagcttcactgaaggagaactctcccctcttgcattcaatttgttcagcttgtttggagcattctgatgttgcttccctcaaagcaagcaaggacacagtttgtgaagaaattcagaatgctctcaatgtaatttcaaatgcttcacaagggatccagaatatgacaaccccaccagaacctcaggcagcaaccctgggaagtgcccttgatgagctggagaatttaattgtcctgaatccactcacagtaactgaggaggaaatacgaccatcactagagaaacgccttgaagccattatcagtggggctgctctgctggcggattcttcatgtacgagggacttacaccgagagcggattatcgcagaatgcaacgccattcgccaggctcttcaggatctgctttcagagtacatgaacaacctctgtaatcaaaagtctgacctgggcctcactggagtaaaaatcaaattgttggaggaatgcattattttctggagtctctag

SEQ ID NO: 114904 - DNA, 470 bp, Homo sapiens
  Payload ID: 2441
  Gene Symbol: CTNNA3
  Gene Name: catenin (cadherin-associated protein), alpha 3
  ENST ID: ENST00000494580
  CDS Start-End: 1-382
tatcagtggggctgctctgctggcggattcttcatgtacgagggacttacaccgagagcggattatcgcagaatgcaacgccattcgccaggctcttcaggatctgctttcagagtacatgaacaacgctggaaaaaaagaaaggagtaataccctgaatattgctttagacaacatgtgtaagaagacaagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtaagcatgctagaactgtaactcactaaagtccaggagaatgaggctcccattctccatttatggttgaattgtacctaaataaaaacttttgacaccgtgttacaaa

SEQ ID NO: 114905 - DNA, 2490 bp, Homo sapiens
  Payload ID: 2442
  Gene Symbol: CTNNAL1
  Gene Name: catenin (cadherin-associated protein), alpha-like 1
  Uniprot ID: Q9UBT7
  ENST ID: ENST00000325551
  CDS Start-End: 88-2292
cctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattct

SEQ ID NO: 114906 - DNA, 761 bp, Homo sapiens
  Payload ID: 2442
  Gene Symbol: CTNNAL1
  Gene Name: catenin (cadherin-associated protein), alpha-like 1
  ENST ID: ENST00000374593
  CDS Start-End: 71-622
gggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataagagactaacaatatataacttaagacacagttaaatcagtggaaatgataattatccacaactacaaaatttctgtactcagagtccctaaatgttactgaataatctcaaaacttacagaacagatttaaactcttccagtccagaagttaatctctcagatgatggtcatg

SEQ ID NO: 114907 - DNA, 824 bp, Homo sapiens
  Payload ID: 2442
  Gene Symbol: CTNNAL1
  Gene Name: catenin (cadherin-associated protein), alpha-like 1
  ENST ID: ENST00000374594
  CDS Start-End: 227-634
catcaatcctggccagctgattctcctctttaccagaacaccattgagcttagtacagaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgc

SEQ ID NO: 114908 - DNA, 2522 bp, Homo sapiens
  Payload ID: 2442
  Gene Symbol: CTNNAL1
  Gene Name: catenin (cadherin-associated protein), alpha-like 1
  Uniprot ID: Q9UBT7
  ENST ID: ENST00000374595
  CDS Start-End: 81-2237
ccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctagattctaa

SEQ ID NO: 114909 - DNA, 3737 bp, Homo sapiens
  Payload ID: 2443
  Gene Symbol: CTNNB1
  Gene Name: catenin (cadherin-associated protein), beta 1, 88kDa
  Uniprot ID: P35222
  ENST ID: ENST00000349496
  CDS Start-End: 281-2626
gccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattgtgtca

SEQ ID NO: 114910 - DNA, 3268 bp, Homo sapiens
  Payload ID: 2443
  Gene Symbol: CTNNB1
  Gene Name: catenin (cadherin-associated protein), beta 1, 88kDa
  Uniprot ID: P35222
  ENST ID: ENST00000396183
  CDS Start-End: 286-2631
gctgcgccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 114911 - DNA, 3356 bp, Homo sapiens
  Payload ID: 2443
  Gene Symbol: CTNNB1
  Gene Name: catenin (cadherin-associated protein), beta 1, 88kDa
  Uniprot ID: P35222
  ENST ID: ENST00000396185
  CDS Start-End: 215-2560
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 114912 - DNA, 2513 bp, Homo sapiens
  Payload ID: 2443
  Gene Symbol: CTNNB1
  Gene Name: catenin (cadherin-associated protein), beta 1, 88kDa
  Uniprot ID: P35222
  ENST ID: ENST00000405570
  CDS Start-End: 157-2502
aaagagggacggaatactgcagtgctagggtgctggagtccagaaatgattttttcgatgaatttaggattttgccgcagtatacatctgcagtcccagaatcctccgggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatccttta

SEQ ID NO: 114913 - DNA, 596 bp, Homo sapiens
  Payload ID: 2443
  Gene Symbol: CTNNB1
  Gene Name: catenin (cadherin-associated protein), beta 1, 88kDa
  ENST ID: ENST00000433400
  CDS Start-End: 558-596
acataattttttgtttaagatccagtaagactccctgtttttaatacatataaagcaacagacatgtatatgtcgataaactgagggtttgcgtccctattgcctggtgcaagctacagcaaaaaaccggtgatatcacatctacaaatctcaatggattcaaaaacaatatgaaaatttttagctgacaagaacatgtctgctgcctgcagtccctgcaatagctcaccatgttgcctactaaccaaaagatcaaaaattatcgatttcatggcgctgcgaggtctggaaagaaaagctactttaaaatttgcattgtttaagaaatgacttaaaagaaaagaatcatttttttttctgaatactttggaaggtgaaaatggcttgttttaatcttatccatgatttactataattctattatttttagcagctggagtccagaaatgattttttcgatgaatttaggattttgccgcagtatacatctgcagtcccagaatcctccgggtatttgaagtataccatacaactgttttgaaaatccagcgtggacaatggctactcaagctgatttgatggagttggacatggcc

SEQ ID NO: 114914 - DNA, 563 bp, Homo sapiens
  Payload ID: 2443
  Gene Symbol: CTNNB1
  Gene Name: catenin (cadherin-associated protein), beta 1, 88kDa
  ENST ID: ENST00000426215
  CDS Start-End: 386-563
agcaaagaatcaccccacacaaagatggcgcgtgcagaatttgtgaaagcgaaaaagaagacgaaggagaagcaaagagggacggaatactgcagtgctagggtgcagctggagtccagaaatgattttttcgatgaatttaggattttgccgcagtatacatctgcagtcccagaatcctccgggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtggg

SEQ ID NO: 114915 - DNA, 608 bp, Homo sapiens
  Payload ID: 2443
  Gene Symbol: CTNNB1
  Gene Name: catenin (cadherin-associated protein), beta 1, 88kDa
  ENST ID: ENST00000441708
  CDS Start-End: 309-608
aaaattttcctgaagtgattggtaagttttggctaattgggagcactagaattgggcccttaatggttggcagggtgtggtggaggagagacagcccttagtccaaaggctcaggccagaaaaagaaagaggaaggctttccttttcctttccggagcagggttctgccctaggtcttgcttggcagtctatttgatttctttagcagttaatgctcagttttttggcatatgtggatctgcctccagagcaggtacaagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccct

SEQ ID NO: 114916 - DNA, 645 bp, Homo sapiens
  Payload ID: 2443
  Gene Symbol: CTNNB1
  Gene Name: catenin (cadherin-associated protein), beta 1, 88kDa
  ENST ID: ENST00000450969
  CDS Start-End: 320-645
agttggggttcgggcgctgaggcagagacgccaccctaagtcccatcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagat

SEQ ID NO: 114917 - DNA, 2841 bp, Homo sapiens
  Payload ID: 2443
  Gene Symbol: CTNNB1
  Gene Name: catenin (cadherin-associated protein), beta 1, 88kDa
  ENST ID: ENST00000453024
  CDS Start-End: 428-2752
ggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcaga

SEQ ID NO: 114918 - DNA, 634 bp, Homo sapiens
  Payload ID: 2443
  Gene Symbol: CTNNB1
  Gene Name: catenin (cadherin-associated protein), beta 1, 88kDa
  ENST ID: ENST00000431914
  CDS Start-End: 186-634
aggtactcctaaggacttgttgaattgcgggcttggcgcccgttctacggagagttcacagccttcgtgagtggggacagaaggcggctcggcccggtgattcaggtcgaaattcaagctgaacagcctgctgagagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccac

SEQ ID NO: 114919 - DNA, 6135 bp, Homo sapiens
  Payload ID: 2444
  Gene Symbol: CTNND1
  Gene Name: catenin (cadherin-associated protein), delta 1
  Uniprot ID: O60716
  ENST ID: ENST00000358694
  CDS Start-End: 464-3265
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114920 - DNA, 6232 bp, Homo sapiens
  Payload ID: 2444
  Gene Symbol: CTNND1
  Gene Name: catenin (cadherin-associated protein), delta 1
  Uniprot ID: O60716
  ENST ID: ENST00000361391
  CDS Start-End: 537-3362
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114921 - DNA, 6295 bp, Homo sapiens
  Payload ID: 2444
  Gene Symbol: CTNND1
  Gene Name: catenin (cadherin-associated protein), delta 1
  Uniprot ID: O60716
  ENST ID: ENST00000361332
  CDS Start-End: 537-3425
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114922 - DNA, 6226 bp, Homo sapiens
  Payload ID: 2444
  Gene Symbol: CTNND1
  Gene Name: catenin (cadherin-associated protein), delta 1
  Uniprot ID: O60716
  ENST ID: ENST00000361796
  CDS Start-End: 537-3356
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114923 - DNA, 6313 bp, Homo sapiens
  Payload ID: 2444
  Gene Symbol: CTNND1
  Gene Name: catenin (cadherin-associated protein), delta 1
  Uniprot ID: O60716
  ENST ID: ENST00000399050
  CDS Start-End: 537-3443
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114924 - DNA, 5832 bp, Homo sapiens
  Payload ID: 2444
  Gene Symbol: CTNND1
  Gene Name: catenin (cadherin-associated protein), delta 1
  Uniprot ID: O60716
  ENST ID: ENST00000415361
  CDS Start-End: 359-2962
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114925 - DNA, 5800 bp, Homo sapiens
  Payload ID: 2444
  Gene Symbol: CTNND1
  Gene Name: catenin (cadherin-associated protein), delta 1
  Uniprot ID: O60716
  ENST ID: ENST00000426142
  CDS Start-End: 432-2930
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114926 - DNA, 6016 bp, Homo sapiens
  Payload ID: 2444
  Gene Symbol: CTNND1
  Gene Name: catenin (cadherin-associated protein), delta 1
  Uniprot ID: O60716
  ENST ID: ENST00000428599
  CDS Start-End: 345-3146
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114927 - DNA, 848 bp, Homo sapiens
  Payload ID: 2444
  Gene Symbol: CTNND1
  Gene Name: catenin (cadherin-associated protein), delta 1
  ENST ID: ENST00000531007
  CDS Start-End: 1-370
tgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatggtaaattctctttatatactgctatctgtctaaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacacactcatgaggttcctgtctctactcatactaacaaattgcatgtgttcacagcaggacgaggggcaggaatctctggaggaagagttggatgtgttggttttggatgatgaggggggccaagtgtcttacccctccatggtatgtcctt

SEQ ID NO: 114928 - DNA, 579 bp, Homo sapiens
  Payload ID: 2444
  Gene Symbol: CTNND1
  Gene Name: catenin (cadherin-associated protein), delta 1
  ENST ID: ENST00000530068
  CDS Start-End: 194-579
aaggctaggtgaggtgtctttggcaaggttgcacagggatccagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccg

SEQ ID NO: 114929 - DNA, 3489 bp, Homo sapiens
  Payload ID: 2444
  Gene Symbol: CTNND1
  Gene Name: catenin (cadherin-associated protein), delta 1
  Uniprot ID: O60716
  ENST ID: ENST00000526938
  CDS Start-End: 324-3080
acccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtc

SEQ ID NO: 114930 - DNA, 5749 bp, Homo sapiens
  Payload ID: 2444
  Gene Symbol: CTNND1
  Gene Name: catenin (cadherin-associated protein), delta 1
  Uniprot ID: O60716
  ENST ID: ENST00000532463
  CDS Start-End: 381-2879
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaataacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114931 - DNA, 5907 bp, Homo sapiens
  Payload ID: 2444
  Gene Symbol: CTNND1
  Gene Name: catenin (cadherin-associated protein), delta 1
  Uniprot ID: O60716
  ENST ID: ENST00000528621
  CDS Start-End: 398-3037
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114932 - DNA, 505 bp, Homo sapiens
  Payload ID: 2444
  Gene Symbol: CTNND1
  Gene Name: catenin (cadherin-associated protein), delta 1
  ENST ID: ENST00000524579
  CDS Start-End: 494-505
agtggtggtgatttgggtctagctttaaatagtgggctttgtgtagctgaagtgagcatcctagttaacctagtgtccaggactatttccacgaactaagggttgttttgactggtgtgtagtacagagcctttggggtgataagatggaagatttgtcttttacctcacctccactggttctttcaggaattataagggatgcagataagtaaatcttttattttttaaattttttgttttgctcattgtcttggttttggggtaaaaaatgatgatagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactca

SEQ ID NO: 114933 - DNA, 5053 bp, Homo sapiens
  Payload ID: 2444
  Gene Symbol: CTNND1
  Gene Name: catenin (cadherin-associated protein), delta 1
  Uniprot ID: O60716
  ENST ID: ENST00000531014
  CDS Start-End: 264-2183
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114934 - DNA, 4966 bp, Homo sapiens
  Payload ID: 2444
  Gene Symbol: CTNND1
  Gene Name: catenin (cadherin-associated protein), delta 1
  Uniprot ID: O60716
  ENST ID: ENST00000526772
  CDS Start-End: 264-2096
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114935 - DNA, 6012 bp, Homo sapiens
  Payload ID: 2444
  Gene Symbol: CTNND1
  Gene Name: catenin (cadherin-associated protein), delta 1
  Uniprot ID: O60716
  ENST ID: ENST00000532844
  CDS Start-End: 398-3142
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114936 - DNA, 5994 bp, Homo sapiens
  Payload ID: 2444
  Gene Symbol: CTNND1
  Gene Name: catenin (cadherin-associated protein), delta 1
  Uniprot ID: O60716
  ENST ID: ENST00000526357
  CDS Start-End: 398-3124
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114937 - DNA, 5655 bp, Homo sapiens
  Payload ID: 2444
  Gene Symbol: CTNND1
  Gene Name: catenin (cadherin-associated protein), delta 1
  Uniprot ID: O60716
  ENST ID: ENST00000532245
  CDS Start-End: 287-2785
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114938 - DNA, 866 bp, Homo sapiens
  Payload ID: 2444
  Gene Symbol: CTNND1
  Gene Name: catenin (cadherin-associated protein), delta 1
  ENST ID: ENST00000534647
  CDS Start-End: 83-866
ccgggcgctggaggaggaacggcgccacgtctcggcgcagctggaacgcgtccgggtctcaccacaagatgccaacccactcatggccaacggcacactcacccgccggcatcaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttgg

SEQ ID NO: 114939 - DNA, 4984 bp, Homo sapiens
  Payload ID: 2444
  Gene Symbol: CTNND1
  Gene Name: catenin (cadherin-associated protein), delta 1
  Uniprot ID: O60716
  ENST ID: ENST00000525902
  CDS Start-End: 264-2114
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114940 - DNA, 4780 bp, Homo sapiens
  Payload ID: 2444
  Gene Symbol: CTNND1
  Gene Name: catenin (cadherin-associated protein), delta 1
  ENST ID: ENST00000529919
  CDS Start-End: 332-3148
gagggctgagggaagatggctgggctgcaagaggcagggggatgggcccgtcagggaggaattcttgtgaaagccgtcgtctgcctcagcacttgatgaaaacacaccgaaaaagaggctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctctt

SEQ ID NO: 114941 - DNA, 5071 bp, Homo sapiens
  Payload ID: 2444
  Gene Symbol: CTNND1
  Gene Name: catenin (cadherin-associated protein), delta 1
  Uniprot ID: O60716
  ENST ID: ENST00000527467
  CDS Start-End: 264-2201
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114942 - DNA, 5751 bp, Homo sapiens
  Payload ID: 2444
  Gene Symbol: CTNND1
  Gene Name: catenin (cadherin-associated protein), delta 1
  Uniprot ID: O60716
  ENST ID: ENST00000532787
  CDS Start-End: 359-2881
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114943 - DNA, 498 bp, Homo sapiens
  Payload ID: 2444
  Gene Symbol: CTNND1
  Gene Name: catenin (cadherin-associated protein), delta 1
  ENST ID: ENST00000533189
  CDS Start-End: 120-498
aagatggctgggctgcaagaggcagggggatgggcccgtcagggaggaattcttgtgaaagccgtcgtctgcctcagcacttgatgaaaacacaccgaaaaagagggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaact

SEQ ID NO: 114944 - DNA, 5745 bp, Homo sapiens
  Payload ID: 2444
  Gene Symbol: CTNND1
  Gene Name: catenin (cadherin-associated protein), delta 1
  Uniprot ID: O60716
  ENST ID: ENST00000528232
  CDS Start-End: 359-2875
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114945 - DNA, 6026 bp, Homo sapiens
  Payload ID: 2444
  Gene Symbol: CTNND1
  Gene Name: catenin (cadherin-associated protein), delta 1
  Uniprot ID: O60716
  ENST ID: ENST00000532649
  CDS Start-End: 517-3156
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114946 - DNA, 5931 bp, Homo sapiens
  Payload ID: 2444
  Gene Symbol: CTNND1
  Gene Name: catenin (cadherin-associated protein), delta 1
  Uniprot ID: O60716
  ENST ID: ENST00000529873
  CDS Start-End: 398-3061
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114947 - DNA, 6024 bp, Homo sapiens
  Payload ID: 2444
  Gene Symbol: CTNND1
  Gene Name: catenin (cadherin-associated protein), delta 1
  Uniprot ID: O60716
  ENST ID: ENST00000534579
  CDS Start-End: 515-3154
cagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114948 - DNA, 6099 bp, Homo sapiens
  Payload ID: 2444
  Gene Symbol: CTNND1
  Gene Name: catenin (cadherin-associated protein), delta 1
  Uniprot ID: O60716
  ENST ID: ENST00000529526
  CDS Start-End: 590-3229
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacgctctctccttcctgcttcctccttgctgtggtggctgggatgcttcttccatgattttttgaatctagactgggctgttctctgtgttaaaccaatcagttgcgaccttctcttaacaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114949 - DNA, 6553 bp, Homo sapiens
  Payload ID: 2444
  Gene Symbol: CTNND1
  Gene Name: catenin (cadherin-associated protein), delta 1
  Uniprot ID: O60716
  ENST ID: ENST00000524630
  CDS Start-End: 514-3315
agaacaggaggagcgctttgggcgggaggctaagtctcgagggacttgagggctgagggaagatggctgggctgcaagaggcagggggatgggcccgtcagggaggaattcttgtgaaagccgtcgtctgcctcagcacttgatgaaaacacaccgaaaaagagggtagggatgctgtagtagagcaggcgccaaggcggttaagggtcatgtccgtcttccctttgaagaggcagtagatgcccttggctctgcctggagcgctccatgtttcgtgatggaagtctctggatggctctgctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccctgccctgcggcggctccgccccttaccttcatggacgactcagaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacctcct

SEQ ID NO: 114950 - DNA, 5925 bp, Homo sapiens
  Payload ID: 2444
  Gene Symbol: CTNND1
  Gene Name: catenin (cadherin-associated protein), delta 1
  Uniprot ID: O60716
  ENST ID: ENST00000530748
  CDS Start-End: 398-3055
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactcatggccaacggcacactcacccgccggcatcagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagatgagtggttctccagagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114951 - DNA, 4990 bp, Homo sapiens
  Payload ID: 2444
  Gene Symbol: CTNND1
  Gene Name: catenin (cadherin-associated protein), delta 1
  Uniprot ID: O60716
  ENST ID: ENST00000533667
  CDS Start-End: 264-2120
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114952 - DNA, 5727 bp, Homo sapiens
  Payload ID: 2444
  Gene Symbol: CTNND1
  Gene Name: catenin (cadherin-associated protein), delta 1
  Uniprot ID: O60716
  ENST ID: ENST00000529986
  CDS Start-End: 359-2857
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114953 - DNA, 5814 bp, Homo sapiens
  Payload ID: 2444
  Gene Symbol: CTNND1
  Gene Name: catenin (cadherin-associated protein), delta 1
  Uniprot ID: O60716
  ENST ID: ENST00000530094
  CDS Start-End: 359-2944
ctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacggacagtacagccagtcgctatgggaccagacgggttgcctgtggatgcttcatcagtttctaacaactatatccagactttgggtcgtgatttccgcaagaatggcaatgggggacctggtccctatgtggggcaagctggcactgctacccttcctaggaacttccactaccctcctgatggttatagtcgccactatgaagatggttatccaggtggcagtgataactatggcagtctgtcccgggtgacccgcattgaggagcggtataggcccagcatggaaggctaccgggcacctagtagacaggatgtgtatgggccccaaccccaggttcgggtaggtgggagcagcgtggatctgcatcgctttcatccagagccttatgggctagaggatgaccagcgtagtatgggctatgatgacctggattatggtatgatgtctgattatggcactgcccgtcggactgggacaccctctgaccctcgtcggcgcctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggaaccctgtggaatctttcatcccatgactcaatcaaaatggagattgtggaccatgcactgcatgccttgacagatgaagtgatcattcctcattctggttgggagcgggaacctaatgaagactgtaagccacgccacattgagtgggaatcggtgctcaccaacacagctggctgccttaggaatgtaagctcagagaggagtgaagctcgccggaaacttcgggaatgtgatggtttagttgatgccctcattttcattgttcaggctgagattgggcagaaggattcagacagcaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaagggaaaaaacctatagaggatccagcaaacgatacagtggatttccctaaaagaacgagtccagctcgaggctatgagctcttatttcagccagaggtggttcggatatacatctcacttcttaaggagagcaagactcctgccatcctagaagcctcagctggagctatccagaacttgtgtgctgggcgctggacgtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggaaccgctcagaaaaagaagttcgagcagcagcacttgtattacagacaatctggggatataaggaactgcggaagccactggaaaaagaaggatggaagaaatcagactttcaggtgaatctaaacaatgcttcccgaagccagagcagtcattcatatgatgatagtactctccctctcattgaccggaaccaaaaatcagataagaaacctgatcgggaagaaattcagatgagcaatatgggatcaaacacaaaatcactagataacaactattccacaccaaatgagagaggagaccacaatagaacactggatcgatcgggggatctaggcgacatggagccattgaagggaacaacacccttgatgcaggacgaggggcaggaatctctggaggaagagttggatgtgttggttttggatgatgaggggggccaagtgtcttacccctccatgcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcct

SEQ ID NO: 114954 - DNA, 5481 bp, Homo sapiens
  Payload ID: 2445
  Gene Symbol: CTNND2
  Gene Name: catenin (cadherin-associated protein), delta 2
  Uniprot ID: Q9UQB3
  ENST ID: ENST00000304623
  CDS Start-End: 191-3868
gcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctcatctatggttctaaatattgcttcaatttcaaacttttgaaagatgtatggatttccagtttttctttactttctcccagtatgttttaacaaaaaaaaaaaaaagcaggaaaaaaggaatatttagcagtattgttcgttctgatatgtgaatttgtttgtgacaactaaacaaggcattcagcagtttctgacaattaacatacatcattccacactccttgtcaacaaagtgctttttcactgcctaaaattttagatgtagatatttgaaatagattttttcatttataccagttttctttatgatgatacagtgttaaaagaaaataaattacaattgatctgtcatccatatttgctaagaatgtctatttccaagaacctatatcttacaaaatacacattcttgcttgtgtgtctgtgtgtgtgggtgtatgtatgtccacgtactagaaaaattacctgtgtgagattttattttgacagaagctatttcatttgctgttcatcttgtacaaactttgtttttggttttttagtataaatgtacatcagtttgttccttttgtactgtatctattcttctgaccatctagtgactcaggatattaggccagttgaagtggagttataggattttcacacattcacgcatacttggatatcaaccctctctacaggtccgtttccttacacattttatcccctcagaacacgataaaccatggccaattcagtttcactttggggccaattacttgaagtatccacagaaaatgtaaactgctcgccttattcccccaaactttttgttcatgtggcagggagcagtacacaactatggaatagattattaaaactgaacttgaagctaacgttagaatagtggttaacagagctaagaaataaggctaaccatcgaaaagaacatgggccgcgggtaaactagctttgctctttagatgcaagtggctgaggccaataggtgcctagtaaatgttaactgttcttggaaaaaataaaaacatcagtaacaaaa

SEQ ID NO: 114955 - DNA, 1962 bp, Homo sapiens
  Payload ID: 2445
  Gene Symbol: CTNND2
  Gene Name: catenin (cadherin-associated protein), delta 2
  ENST ID: ENST00000458100
  CDS Start-End: 480-1442
cgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagatt

SEQ ID NO: 114956 - DNA, 3567 bp, Homo sapiens
  Payload ID: 2445
  Gene Symbol: CTNND2
  Gene Name: catenin (cadherin-associated protein), delta 2
  ENST ID: ENST00000504499
  CDS Start-End: 191-886
gcgtcgggagccgcctctcgcccgcggcgctcgcccctgccgcccgccagcatcccttgtcccgcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgag

SEQ ID NO: 114957 - DNA, 3818 bp, Homo sapiens
  Payload ID: 2445
  Gene Symbol: CTNND2
  Gene Name: catenin (cadherin-associated protein), delta 2
  ENST ID: ENST00000513588
  CDS Start-End: 128-2866
gcggccgcgctcagacaacaaaagcggaagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaactggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagggctgggctgaggatgtggcaggcatggcatatgccctacgttcactgccagagggggctccctgcctgccacagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacaggagcacattctgcctccatgtgcagaccctacaagggaacacctcagcgctgctcctgagacgtttcctgaacgggagaacctaactcattacatggactctagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgccgccgtgtttcctca

SEQ ID NO: 114958 - DNA, 704 bp, Homo sapiens
  Payload ID: 2445
  Gene Symbol: CTNND2
  Gene Name: catenin (cadherin-associated protein), delta 2
  ENST ID: ENST00000502551
  CDS Start-End: 77-704
cacaggtttcgggggcttctgcgtgctgacaatagacagccaggctccagaaagcgccgcctgaaagccaggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaactggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgc

SEQ ID NO: 114959 - DNA, 727 bp, Homo sapiens
  Payload ID: 2445
  Gene Symbol: CTNND2
  Gene Name: catenin (cadherin-associated protein), delta 2
  ENST ID: ENST00000508761
  CDS Start-End: 220-727
attacgatgtttggctagaacaaaatggaaagacttagtcatatgcgtccatggccgtgtcttcaggctcccgcggcttgccagaccctgagcccccttggtctatatttagcggcttcccagcaagcctttgcagccggcttcacaggtttcgggggcttctgcgtgctgacaatagacagccaggctccagaaagcgccgcctgaaagccaggagctatgcctgttccagaccagccttcatcagcctcagagaagacgagttccctgagccccggcttaaacacctccaacggggatggctctgaaacagaaaccacctctgccatcctcgcctcagtcaaagaacaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaacca

SEQ ID NO: 114960 - DNA, 4336 bp, Homo sapiens
  Payload ID: 2445
  Gene Symbol: CTNND2
  Gene Name: catenin (cadherin-associated protein), delta 2
  ENST ID: ENST00000511377
  CDS Start-End: 374-3778
actgtttgcgagtgaaagcagaaattaccataggataattcagcgtcctgactttttcgaggctgttcttcactcccttctcggtttttgagctgctctgtggttccttttagccgtggtgcagggagggaggagggaggtgggtaggatgccaggaaccgcctgctccacagcctggggaaggagggaagagtaacccttcatctttgggactagtcgtcttgtttgcctagactacagttttcaagtatttaaggaccatttatttcaaaaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgccccagggcggttcgcccaccaagctgcagcgcggcggctcggcccccgagggcgccacctacgccgcgccgcgcggctcctcgcccaagcagtcgcccagccgcctggccaagtcctacagcaccagctcgcccatcaacatcgtcgtgtcctcggccggcctgtccccgatccgcgtgacctcgccccccaccgtgcagtccaccatctcctcctcgcccatccaccagctgagctccaccatcggcacgtacgccaccctgtcgcccaccaagcgcctggtccacgcgtccgagcagtacagcaagcactcgcaggagctgtatgccacggccaccctccagaggccgggcagcctggcagctggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccataggaaggctgtgataaccagtaaggaaatattaagagctattttagaaagctaaatgaatcgcaagttaacttggaaatcagtagaaagctaaagtgatcctaaatatgacagtgggcagcacctttctagcgtgagctgtagagtaacgagaagtgctttatactgaacgtggttgatgggaggagagacgaggcattcgggccggtggggcgtaagggttatcgttaagcacaagacacagaatagtttacacactgtgtgggggacggcttctcacgctttgtttactctcttcatccgttgtgactctaggcttcaggttgcattggggttcctctgtacagcaagatgtttcttgccttttgttaatgcattgttgtaaagtatttgatgtacattacagattaaagaagaaaagcgcgttgtgtatattacaccaatgcc

SEQ ID NO: 114961 - DNA, 720 bp, Homo sapiens
  Payload ID: 2445
  Gene Symbol: CTNND2
  Gene Name: catenin (cadherin-associated protein), delta 2
  ENST ID: ENST00000513598
  CDS Start-End: 177-720
gggactagtcgtcttgtttgcctagactacagttttcaagtatttaaggaccatttatttcaaaaggtacagtaaaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaaggcccagcctgctctcccagagtgcacttcagctcaattccaaacctgaagggtctttccagtatccggccagctaccatagcaaccagaccctggccctgggggaaaccaccccttcacagctcccggcccgaggcacacaagcccgagctacgggccagagcttcagccagggcacgaccagccgcgccggccacctggcggggcccgagcccgcgccgccgccgccgccgccgccgcgggagccgttcgcgcccagcctgggcagcgccttccacctgcccgacgcgccgcccgccgccgccgccgccgcgctctactactccagctccacgctgcccgcgccgccgcgcgggggctccccgctggccgcgcccc

SEQ ID NO: 114962 - DNA, 2982 bp, Homo sapiens
  Payload ID: 2445
  Gene Symbol: CTNND2
  Gene Name: catenin (cadherin-associated protein), delta 2
  ENST ID: ENST00000503622
  CDS Start-End: 203-2869
agcctggggaaggagggaagagtaacccttcatctttgggactagtcgtcttgtttgcctagactacagttttcaagtatttaaggaccatttatttcaaaaggaattacagtttgaaaggctgacccgagagctggaggctgaacggcagatcgtagccagccagctggagcgatgcaagctcggatccgagactggcagcatgagcagcatgagttcagcagaagagcagtttcagtggcagtcacaagatggtcaaaaagatatcgaagatgagcttacaacaggtctcgagctggtggactcctgtattaggtcactacaggaatcaggaatacttgacccacaggattattctacaggtgaaactggttcccgagcctcatacagcagccagcatgggcacctgggcccagagttgcgggccctgcagtccccagaacaccacatagatcccatctatgaagaccgcgtctatcagaagccccctatgaggagtctcagccagagccagggggaccctctgccgccagcacacaccggcacctaccgcacgagcacagccccatcttcccctggtgtcgactccgtccccttgcagcgcacaggcagccagcacggcccacagaatgccgccgcggccaccttccagagggccagctatgccgccggcccagcctccaattacgcggacccctaccgacagctgcagtattgtccctctgttgagtctccatacagcaaatccggccctgctctcccgcctgaaggcaccttggccaggtccccgtccattgatagcattcagaaagatcccagagaatttggatggagagacccggaactgccggaagtgattcagatgttgcagcaccagtttccctcggtccagtctaacgcggcagcctacttgcaacacctctgttttggagacaacaaaattaaagccgagataaggagacaaggaggcatccagctcctggtggacctgttggatcatcggatgaccgaagtccaccgtagtgcctgtggagctctgagaaacctggtgtatgggaaggccaacgatgataacaaaattgccctgaaaaactgtggtggcatcccagcactggtgaggttactccgcaagacgactgacctggagatccgggagctggtcacaggagtcctttggaacctctcctcatgcgatgcactcaaaatgccaatcatccaggatgccctagcagtactgaccaacgcggtgattatcccccactcaggctgggaaaattcgcctcttcaggatgatcggaaaatacagctgcattcatcacaggtgctgcgtaacgccaccgggtgcctaaggaatgttagttcggccggagaggaggcccgcagaaggatgagagagtgtgatgggcttacggatgccttgctgtacgtgatccagtctgcgctggggagcagtgagatcgatagcaagaccgttgaaaactgtgtgtgcattttaaggaacctctcgtaccggctggcggcagaaacgtctcagggacagcacatgggcacggacgagctggacgggctactctgtggcgaggccaatggcaaggatgctgagagctctgggtgctggggcaagaagaagaagaaaaagaaatcccaagatcagtgggatggagtaggacctcttccagactgtgctgaaccaccaaaagggatccagatgctgtggcacccatcaatagtcaaaccctacctcacactgctctctgagtgctcaaatccagacacgctggaaggggcggcaggcgccctgcagaacttggctgcagggagctggaagtggtcagtatatatccgagccgctgtccgaaaagagaaaggcctgcccatcctcgtggagctgctccgaatagacaatgaccgtgtggtgtgcgcggtggccactgcgctgcggaacatggccttggacgtcagaaataaggagctcatcggcaaatacgccatgcgagacctagtccacaggcttccaggagggaacaacagcaacaacactgcaagcaaggccatgtcggatgacacagtgacagctgtctgctgcacactgcacgaagtgattaccaagaacatggagaacgccaaggccttacgggatgccggtggcatcgagaagttggtcggcatctccaaaagcaaaggagataaacactctccaaaagtggtcaaggctgcatctcaggtcctcaacagcatgtggcagtaccgagatctgaggagtctctacaaaaaggatggatggtcacaataccactttgtagcctcgtcttcaaccatcgagagggaccggcaaaggccctactcctcctcccgcacgccctccatctcccctgtgcgcgtgtctcccaacaaccgctcagcaagtgccccagcttcacctcgggaaatgatcagcctcaaagaaaggaaaacagactacgagtgcaccggcagcaacgccacctaccacggagctaaaggcgaacacacttccaggaaagatgccatgacagctcaaaacactggaatttcaactttgtataggaattcttatggtgcgcccgctgaagacatcaaacacaaccaggtttcagcacagccagtcccacaggagcccagcagaaaagattacgagacctaccagccatttcagaattccacaagaaattacgatgagtccttcttcgaggaccaggtccaccatcgccctcccgccagcgagtacaccatgcacctgggtctcaagtccaccggcaactacgttgacttctactcagctgcccgtccctacagtgaactgaactatgaaacgagccactacccggcctcccccgactcctgggtgtgaggagcagggcacaggcgctccgggaacagtgcatgtgcatgcataccacaagacatttctttctgttttgtttttttctcctgcaaatttagtttgttaaagcctgttccata

SEQ ID NO: 114963 - DNA, 451 bp, Homo sapiens
  Payload ID: 2446
  Gene Symbol: CTNNBIP1
  Gene Name: catenin, beta interacting protein 1
  Uniprot ID: Q9NSA3
  ENST ID: ENST00000377256
  CDS Start-End: 147-392
tgtgggtgcaggtttcctgggcttgccagacacacagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcc

SEQ ID NO: 114964 - DNA, 852 bp, Homo sapiens
  Payload ID: 2446
  Gene Symbol: CTNNBIP1
  Gene Name: catenin, beta interacting protein 1
  Uniprot ID: Q9NSA3
  ENST ID: ENST00000377258
  CDS Start-End: 339-584
gtggctactctcctgagcttgtctgtggtggctttaaccttgaacaaaccctccagggtttgtgggtggattcctattgtatcaggtgctgtattttcccctcttctggagcaagtgcgtcttttctgatcttccttcccttcagctccagctgccactgtccttgccttcagactggacaaggccttgtgacccatcaggagtttttgtcccgataccgtttcccacaggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaa

SEQ ID NO: 114965 - DNA, 3000 bp, Homo sapiens
  Payload ID: 2446
  Gene Symbol: CTNNBIP1
  Gene Name: catenin, beta interacting protein 1
  Uniprot ID: Q9NSA3
  ENST ID: ENST00000377263
  CDS Start-End: 313-558
accgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggaccgacagacttgacaacggtgacagcactggggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaaggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttcacatttggggtttgtgtttgattggctttcgatgcgtgtgtttggtttcccattggttcacctgtgactcctgttgccatggattcacccccctctgctgccggctctgggcctgagggtccacctggagagtacatttgctttaatgagtgcacctgcctccaccagcaaggggaccccgagaaccctgagcagggtccacagctggaaagttgggcccctgaggagctttgtgtcgtcttgaacgagcagcccagggcctagaggtaaccgttaggcgggatttatgtgcactgcctgcatgagctggcaaccagccagcgtcccttggtgagaaagggattgctgaggcaccgtccaggccccaccggccaggccgcgcccagcagaggcgtactacccagctctgtcctcttggccatccttctgtgtaccacttcctgaggcctcattttgggggtcatcttggaaaggggaggagcttctcccagtgtgagaccccaaagactctggaggtcatctggcggaggtctctgggagcccagaacccacataaaagccccagcttggctcacaaggcccaggagacctccagctaaacaccaacccctgacctaccccagccaggctcctacctgtctgctgccagcacagtaggtcccggccagctctggagttctctcatcggaggcccatgccctccactccactgcctttggaagggtctctctccaggtcagcctggaagggacagtatcgtttgtttatgaaatgccactgggacagctggctgggccttcaccaagcaagtcccttcagactggcccttaagccaaactcaggcccagaattgcagttcagaatggcagtcctggaggcagggggtgaggggcaggtctagtgttcctgcaccaaacctaagtccttccacctgccacccccttccctgggagggaggtggtcctcctatctccctggctcactggcaggtgtgggatctggggagagcggctggagaaagatgcagtcctcaggaagggggccgccaccctcccctatgctggtagatgctgaggcccctaggtgcccagggccagtgggaccctctcagaaccaaatctttcccctttctcggggcttggggctcgggccgtaggggctcctgagtgtcatgaagtgcacaggagccaaatgaccgagccctggagagccccatggtgggtaggtggttcgtgctgtgctctggcaccatcagcctgttccagaaggaggattcgagcatcaggctaagaccctgtgtcctccaccatgcactcacccctagccctggttagctgacagtcagctgtggggaacacagctacaaccctaccctggcagggacctgagagcatctcaggaggggcagcgcatgtgtgcatgtgctgtgtgagtgagcacacccgtgtgcacactcatacacatgtgcacacacacgcactctccccgctcaggggcctggaggtctggctgagcccctggggaaaggtgagttctttcatctccctcctccaggtcggagtgcctggagtcaggtgtcgaggccacattgctggctgccccctctttgtagctcctataaagggcccacacctggtggatacctggttgagtgtgtggtctctgccccagcctgtccttgtcacgatcacaggccttgcttttgtaacaatgatgaccccggcctgtctcatcttctgaagaggaaaagtcaaagtgttgctgtggctccatatttcaactaaaaatatatctgttggagaaagaaattaacaataaagaattttcataggtt

SEQ ID NO: 114966 - DNA, 1206 bp, Homo sapiens
  Payload ID: 2446
  Gene Symbol: CTNNBIP1
  Gene Name: catenin, beta interacting protein 1
  Uniprot ID: Q9NSA3
  ENST ID: ENST00000400904
  CDS Start-End: 352-597
agcccgcgcggagccagatgccgccccctccgccggtccctcccccggcggcctggcgcctccctccctccccaccgcggtgactctcggagcgggaggcggaggctgaggcggccgctcctgctgctgctactgccgccgccgcagcggctgctcgggctgagcacgccccggaacaggccgccgcgcgctgcgcgccggacccgctgcccctgccggcccggccgggtcgggcggcccagggcggcaccttcctacttctgcccagccacagccctcccctcacagttgagcacctgtttgcctgaagttaatttccagaagcaggagtccccagagccaggcagggggatgaaccgcgagggagctcccgggaagagtccggaggagatgtacattcagcagaaggtccgagtgctgctcatgctgcggaagatgggatcaaacctgacagccagcgaggaggagttcctgcgcacctatgcaggggtggtcaacagccagctcagccagctgcctccgcactccatcgaccagggtgcagaggacgtggtgatggcgttttccaggtcggagacggaagaccggaggcagtagctgcaaagcccttggaacaccctggatgctgttgagggccaagagatctgtgtggctcctgggccggctgagtggcagcagccccccttgccccacctcccccttcccctacccaaccctgccctgccccaccccacctcacagctactcagtggggctggcatcaagggagacaccagtggtgcgtttataattggcttaaagggatggacttgtgattggctgcaggaagaaacttttttattttttaaatcttgaccaacagaaaccttttatttttatttctgactcttattttttaaaaaatttgcgcctcggtatctggcttccctggaagctctccgagctctggtgctttagttaggtcatttttttagaaatgtgaagaggtctgattggctgcttaaactggaaaggatctgtgattggctggttaatgggaaacggtttttttctttggctgcaggtgttctgctgatatcaacagcttccctattttgaatgcagaaaacagggtctgggacattagtcgttatatttgacttgaaaagaaagaaaccaagtgcgctttgcaatatttattacacaaagaacttgctgctgccttca

SEQ ID NO: 114967 - DNA, 1925 bp, Homo sapiens
  Payload ID: 2447
  Gene Symbol: CTNNBL1
  Gene Name: catenin, beta like 1
  Uniprot ID: Q8WYA6
  ENST ID: ENST00000361383
  CDS Start-End: 118-1809
attggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtatccccgggcca

SEQ ID NO: 114968 - DNA, 1130 bp, Homo sapiens
  Payload ID: 2447
  Gene Symbol: CTNNBL1
  Gene Name: catenin, beta like 1
  Uniprot ID: Q8WYA6
  ENST ID: ENST00000373469
  CDS Start-End: 79-1014
cgtgaaaaatttgtcctggggaaggaagcaagaccccttaacatttttctcatttctcctatttccccataggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtatccccgggcca

SEQ ID NO: 114969 - DNA, 1493 bp, Homo sapiens
  Payload ID: 2447
  Gene Symbol: CTNNBL1
  Gene Name: catenin, beta like 1
  Uniprot ID: Q8WYA6
  ENST ID: ENST00000373473
  CDS Start-End: 247-1377
gggaagagtgctgtggtgagtgagggattttgccatggagaaggagaaggacccatagcagtttgtcaggttcatggaatccgagctggacctaaatgacatcattcaggagatgcacgtggtggccaccatgccagacctgtaccaccttctggtggagctgaatgctgtacagtcgcttctcggcttgctcggacacgataatacagatatcctttcagatctgacctcagtaggagagctgacatggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtatccccgggcca

SEQ ID NO: 114970 - DNA, 2076 bp, Homo sapiens
  Payload ID: 2447
  Gene Symbol: CTNNBL1
  Gene Name: catenin, beta like 1
  Uniprot ID: Q8WYA6
  ENST ID: ENST00000405275
  CDS Start-End: 351-1961
gtccttttaccgcggtgtggccggctcgcttgtcgctcgcacttttgccctattggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccaggggcatggatggagacacgcacacacacaggcaataggcctcaagattattggcgagtaaaggcatctatctattatcgtgaagcctactctgagctttgacccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtatccccgggcc

SEQ ID NO: 114971 - DNA, 778 bp, Homo sapiens
  Payload ID: 2447
  Gene Symbol: CTNNBL1
  Gene Name: catenin, beta like 1
  ENST ID: ENST00000447935
  CDS Start-End: 280-778
actttacggcagtgtggctggagccgcggctgacgggcccgcggtctgggcgtgagtgcagggaagtggagtatttgctgggccgggtaccatggacgtgggcgaacttctgagctaccaggagggtcattgcgaggagcagtagagctgcactgccgaatgtcgtagccactagccacataggctgttgattgcttgaaatgtgactagtctgaattgagaaatactcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtgg

SEQ ID NO: 114972 - DNA, 1990 bp, Homo sapiens
  Payload ID: 2447
  Gene Symbol: CTNNBL1
  Gene Name: catenin, beta like 1
  ENST ID: ENST00000621317
  CDS Start-End: 169-1875
gtccttttaccgcggtgtggccggctcgcttgtcgctcgcacttttgccctattggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatatcctttcagatctgacctcagttgctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtatccccgggcc

SEQ ID NO: 114973 - DNA, 1958 bp, Homo sapiens
  Payload ID: 2447
  Gene Symbol: CTNNBL1
  Gene Name: catenin, beta like 1
  Uniprot ID: Q8WYA6
  ENST ID: ENST00000628103
  CDS Start-End: 244-1854
tgacgggcccgcggtctgggcgtgagtgcagggaagtggagtatttgctgggccgggtaccatggacgtgggcgaacttctgagctaccaggggcatggatggagacacgcacacacacaggcaataggcctcaagattattggcgagtaaaggcatctatctattatcgtgaagcctactctgagctttgacccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggt

SEQ ID NO: 114974 - DNA, 745 bp, Homo sapiens
  Payload ID: 2448
  Gene Symbol: CAMP
  Gene Name: cathelicidin antimicrobial peptide
  ENST ID: ENST00000296435
  CDS Start-End: 157-678
gtcctgtgaagcaatagccaggggctaaagcaaaccccagcccacaccctggcaggcagccagggatgggtggatcaggaaggctcctggttgggcttttgcatcaggctcaggctgggcataaaggaggctcctgtgggctagagggaggcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctagtgtgtgccctaccctggctcaggcttctgggctctgagaaataaactatgagagcaatttcctcagg

SEQ ID NO: 114975 - DNA, 1898 bp, Homo sapiens
  Payload ID: 2449
  Gene Symbol: CTSA
  Gene Name: cathepsin A
  Uniprot ID: P10619
  ENST ID: ENST00000191018
  CDS Start-End: 86-1528
cgggcgcctcctggagagcaaggacgcgggggagcagaggtgagctggcaccggaggctggaggggatccccgagcccgggatcgatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 114976 - DNA, 1820 bp, Homo sapiens
  Payload ID: 2449
  Gene Symbol: CTSA
  Gene Name: cathepsin A
  ENST ID: ENST00000354880
  CDS Start-End: 5-1450
acacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 114977 - DNA, 1972 bp, Homo sapiens
  Payload ID: 2449
  Gene Symbol: CTSA
  Gene Name: cathepsin A
  Uniprot ID: P10619
  ENST ID: ENST00000372459
  CDS Start-End: 194-1636
agaggtgagctggcaccggaggctggaggggatccccgagcccgggatcggtgcgcggcagaggaggctcgcgggtgggagctggcgctggggccggggcttccctcgcggaggcgccgccagcaactccccgggggctgctgcacggaagcgctgaggagcgagtcaacagcccctctgctgcctcccgtagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgataga

SEQ ID NO: 114978 - DNA, 2149 bp, Homo sapiens
  Payload ID: 2449
  Gene Symbol: CTSA
  Gene Name: cathepsin A
  ENST ID: ENST00000372484
  CDS Start-End: 283-1779
gcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 114979 - DNA, 606 bp, Homo sapiens
  Payload ID: 2449
  Gene Symbol: CTSA
  Gene Name: cathepsin A
  ENST ID: ENST00000419493
  CDS Start-End: 1-606
caagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgca

SEQ ID NO: 114980 - DNA, 403 bp, Homo sapiens
  Payload ID: 2449
  Gene Symbol: CTSA
  Gene Name: cathepsin A
  ENST ID: ENST00000607482
  CDS Start-End: 75-403
agaggtgagctggcaccggaggctggaggggatccccgagcccgggatcggtgcgcggcagaggaggctcgcggatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccct

SEQ ID NO: 114981 - DNA, 584 bp, Homo sapiens
  Payload ID: 2449
  Gene Symbol: CTSA
  Gene Name: cathepsin A
  ENST ID: ENST00000606394
  CDS Start-End: 14-262
gtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggcct

SEQ ID NO: 114982 - DNA, 3056 bp, Homo sapiens
  Payload ID: 2449
  Gene Symbol: CTSA
  Gene Name: cathepsin A
  ENST ID: ENST00000606788
  CDS Start-End: 1183-1878
taaactagtgccggacagacgaaggcctagcacatgggctacggagccctagtagattccagtccccacactgagccaggaggggtcgctgcccagggatacctacagccatactcgagctggacaaggcgcacgctctttgtggaagcaaacacgtccaccaccgcgtagaggggctgcgcagctggcagtccccgggcgctcgggcccatgtcctcgccgttgatgatgatgtgcatgtcggccgtgccatcggggcgcgggcaaaagaggacacccaggcggctacggcgcgcggtcggaggcagcacgttcagctcatagagctggtccaagagatggctgtagagccctggccggctgcggcccaccaggcggtcccggggaatgcgaaactgctcaatgcgcagatatggttccacgaggagggttggaggtcggctgggggccgctgcctccgcctccgggcggccctcccggggcacgcggttgtggtggcgcgtgatggcgaagacccaggtgtggcccaggttgaccagatcgggcagagaaaactcgggaacgggggccagactggcggggtccagcgcggtcagaccgagacgcagatgtccgcaccagcccagctctttctcctcgatctcgaccaggaagacctggcccggggccagcggctcgcggctgaagcacacgccgtgggcgaagctctccacgcgtgtggcccgcgtcccagaggggtccacgcggatgttggcaccgtgcacccgatggaagcgggtgggagggggctccgggcgctcgagtccccagagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 114983 - DNA, 2028 bp, Homo sapiens
  Payload ID: 2450
  Gene Symbol: CTSB
  Gene Name: cathepsin B
  Uniprot ID: P07858
  ENST ID: ENST00000345125
  CDS Start-End: 224-1243
ggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtgggcagcacggggaaggacctgtgagtggccaacctggttcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaa

SEQ ID NO: 114984 - DNA, 3875 bp, Homo sapiens
  Payload ID: 2450
  Gene Symbol: CTSB
  Gene Name: cathepsin B
  Uniprot ID: P07858
  ENST ID: ENST00000353047
  CDS Start-End: 255-1274
gggcggcggaaggtggcgggagggggtgggggctgggaagcaccgtgcgcgggcggcgggagggcccgggcggggctgcgcggtggtcacgtggggcggggccgggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 114985 - DNA, 2011 bp, Homo sapiens
  Payload ID: 2450
  Gene Symbol: CTSB
  Gene Name: cathepsin B
  Uniprot ID: P07858
  ENST ID: ENST00000453527
  CDS Start-End: 187-1206
ggctgcagggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttg

SEQ ID NO: 114986 - DNA, 573 bp, Homo sapiens
  Payload ID: 2450
  Gene Symbol: CTSB
  Gene Name: cathepsin B
  ENST ID: ENST00000532656
  CDS Start-End: 362-573
agggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagatacttctgaaaatagaaatgatgactctgggatgcaaacgttggctgtcctatgtataaggagatggcttttcacgctcccagtgactgaggaagtttctcccagatggcgctgctctgagcctggtgcagggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagag

SEQ ID NO: 114987 - DNA, 559 bp, Homo sapiens
  Payload ID: 2450
  Gene Symbol: CTSB
  Gene Name: cathepsin B
  ENST ID: ENST00000526645
  CDS Start-End: 152-559
agctcctaggttccttcgcagtgacagccactcttttctatttcacgctggcggccccttgagccccaacctggataccataggggaggagcagagaagccaggaacaccacagccctgggccaaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggag

SEQ ID NO: 114988 - DNA, 368 bp, Homo sapiens
  Payload ID: 2450
  Gene Symbol: CTSB
  Gene Name: cathepsin B
  ENST ID: ENST00000524654
  CDS Start-End: 272-368
gcctcacctaggtaacgctgattcctccacggaggatgtgcttctgagtggtccgttgggtgctgtgctgatgagcatcacccagcattttacgacacatgtgctgccccagagggctgggctcccgtcagagctcttttccactggctgggtgcggtggctcacacctgtaatcccagcactttgggaggctgaggccagtggatcacctgaggtcaggagttcgagaccagcctggctaacatggtggatctaggatccggcttccaacatgtggcagctctgggcctccctctgctgcctgctggtgttggccaatgcccggagcaggccctctttccatcccctgtcggatgagctggtcaact

SEQ ID NO: 114989 - DNA, 2009 bp, Homo sapiens
  Payload ID: 2450
  Gene Symbol: CTSB
  Gene Name: cathepsin B
  Uniprot ID: P07858
  ENST ID: ENST00000533455
  CDS Start-End: 220-1239
ggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaag

SEQ ID NO: 114990 - DNA, 570 bp, Homo sapiens
  Payload ID: 2450
  Gene Symbol: CTSB
  Gene Name: cathepsin B
  ENST ID: ENST00000532392
  CDS Start-End: 509-570
gcggctgcagggctccggcaaccgctccggcaacgccaaccgctccgctgcgcgcaggctgggctgcaggctctcggctgcagcgctgggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggtggagtctgactctctcacccaggctggagtgcagtggcaagatctcagctcactgcaactccgcttcctgtgttcaagccattctcctgcctcagtctctcaactagctgcgattacaggtggatctaggatccggcttccaacatgtggcagctctgggcctccctctgctgcctgctggtgttggccaatgcccggagcaggcc

SEQ ID NO: 114991 - DNA, 1436 bp, Homo sapiens
  Payload ID: 2450
  Gene Symbol: CTSB
  Gene Name: cathepsin B
  Uniprot ID: P07858
  ENST ID: ENST00000531089
  CDS Start-End: 226-1245
ggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcgggagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaa

SEQ ID NO: 114992 - DNA, 545 bp, Homo sapiens
  Payload ID: 2450
  Gene Symbol: CTSB
  Gene Name: cathepsin B
  ENST ID: ENST00000527215
  CDS Start-End: 341-545
gcggctgcagggctccggcaaccgctccggcaacgccaaccgctccgctgcgcgcaggctgggctgcaggctctcggctgcagcgctgggaagagaaaccagacagcgaaaccaagaggcgaatgggcgattggatgccggtggggagaaggccgggggcgcaccctgctcctggactccagtaaagggaggccgggcagagtccctggggcgccacctccccctcggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccac

SEQ ID NO: 114993 - DNA, 556 bp, Homo sapiens
  Payload ID: 2450
  Gene Symbol: CTSB
  Gene Name: cathepsin B
  ENST ID: ENST00000528965
  CDS Start-End: 391-556
gaaggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttga

SEQ ID NO: 114994 - DNA, 975 bp, Homo sapiens
  Payload ID: 2450
  Gene Symbol: CTSB
  Gene Name: cathepsin B
  ENST ID: ENST00000533572
  CDS Start-End: 466-975
caggaccgccgagggaggcgcctgcgaggaagagctcggccgggtccggagactgctgcctgggaccgcgctcccagcgcctgggcctcggtgtctccgggccaaactgccgacataatcgcatctgccggcatctattttcggtttatttccccctcattgcgaaggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggt

SEQ ID NO: 114995 - DNA, 1989 bp, Homo sapiens
  Payload ID: 2450
  Gene Symbol: CTSB
  Gene Name: cathepsin B
  Uniprot ID: P07858
  ENST ID: ENST00000534510
  CDS Start-End: 215-1234
ggctggcccaggctacggcggctgcagggctccggcaaccgctccggcaacgccaaccgctccgctgcgcgcaggctgggctgcaggctctcggctgcagcgctggcacgctggcggccccttgagccccaacctggataccataggggaggagcagagaagccaggaacaccacagccctgggccaaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccc

SEQ ID NO: 114996 - DNA, 580 bp, Homo sapiens
  Payload ID: 2450
  Gene Symbol: CTSB
  Gene Name: cathepsin B
  ENST ID: ENST00000527243
  CDS Start-End: 150-580
aaaatagaaatgatgactctgggatgcaaacgttggctgtcctatgtataaggagatggcttttcacgctcccagtgactgaggaagtttctcccagatggcgctgctctgagcctggtgcagggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcag

SEQ ID NO: 114997 - DNA, 561 bp, Homo sapiens
  Payload ID: 2450
  Gene Symbol: CTSB
  Gene Name: cathepsin B
  ENST ID: ENST00000530296
  CDS Start-End: 67-561
gtcttaaggattaaagctgtttggggagtgtctggaggagggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaa

SEQ ID NO: 114998 - DNA, 1389 bp, Homo sapiens
  Payload ID: 2450
  Gene Symbol: CTSB
  Gene Name: cathepsin B
  Uniprot ID: P07858
  ENST ID: ENST00000530640
  CDS Start-End: 138-1157
ggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcgggagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctcta

SEQ ID NO: 114999 - DNA, 764 bp, Homo sapiens
  Payload ID: 2450
  Gene Symbol: CTSB
  Gene Name: cathepsin B
  ENST ID: ENST00000534382
  CDS Start-End: 553-764
aattttttgtatttttactagagacggggtttcaccgtgttagccaggataatcttgatctcctgacctcgtgatccgcccgcctcggcctcccaaagtgctgggattacaggcgtgagccactgcacccggctactgccttcttactgtcgccacagcctggataaaatacgattcttctgagccttttttttttttttaatacagagtttcactcttgttgcctaggctggagtgcaatagtgcgatctctggtcaccgcaacctccgcctcccgggttcaagcgattctcctgcttcagtctcccgagtagctgggattactgacacgcgccaccacgcccggctagttttgtatttttagtagagacggggtttctccatgttggtcaggatggtctcgaactcccgacctcaggtgactcaccggcctcggcctcccaaaatgctgggattacaggcgtgagccaccgaacccagcccctctgagcctcttgaatacaactggggtcatgcctgctttgcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagag

SEQ ID NO: 115000 - DNA, 540 bp, Homo sapiens
  Payload ID: 2450
  Gene Symbol: CTSB
  Gene Name: cathepsin B
  ENST ID: ENST00000505496
  CDS Start-End: 237-540
gcgcgcaggctgggctgcaggctctcggctgcagcgctgggctggtgtgcagtggtgcgaccacggctcacggcagcctcagccacccagatgtaagcgatctggttcccacctcagcctcccgagtacacgctggcggccccttgagccccaacctggataccataggggaggagcagagaagccaggaacaccacagccctgggccaaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagacc

SEQ ID NO: 115001 - DNA, 557 bp, Homo sapiens
  Payload ID: 2450
  Gene Symbol: CTSB
  Gene Name: cathepsin B
  ENST ID: ENST00000531502
  CDS Start-End: 282-557
acttagggccggggctggcccaggctacggcggctgcagggctccggcaaccgctccggcaacgccaaccgctccgctgcgcgcaggctgggctgcaggctctcggctgcagcgctgggaagagaaaccagacagcgaaaccaagaggcgaatgggcgattggatgccggtggggagaaggccgggggcgcaccctgctcctggactccagtaaagggaggccgggcagagtccctggggcgccacctccccctcggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacag

SEQ ID NO: 115002 - DNA, 573 bp, Homo sapiens
  Payload ID: 2450
  Gene Symbol: CTSB
  Gene Name: cathepsin B
  ENST ID: ENST00000524500
  CDS Start-End: 278-573
aaccgctccggcaacgccaaccgctccgctgcgcgcaggctgggctgcaggctctcggctgcagcgctggggtcttgctttgtctcccaggctggtgtgcagtggtgcgaccacggctcacggcagcctcagccacccagatgtaagcgatctggttcccacctcagcctcccgagtagtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagat

SEQ ID NO: 115003 - DNA, 524 bp, Homo sapiens
  Payload ID: 2450
  Gene Symbol: CTSB
  Gene Name: cathepsin B
  ENST ID: ENST00000534149
  CDS Start-End: 95-524
ccttctcctcttagaaatcctgacgcagctcctaggttccttcgcagtgacagccactcttttctatttgtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggca

SEQ ID NO: 115004 - DNA, 633 bp, Homo sapiens
  Payload ID: 2450
  Gene Symbol: CTSB
  Gene Name: cathepsin B
  ENST ID: ENST00000534636
  CDS Start-End: 109-633
aaccgctccgctgcgcgcaggctgggctgcaggctctcggctgcagcgctgggtgagtgctggggacccggggccaccgcagcgtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcc

SEQ ID NO: 115005 - DNA, 1855 bp, Homo sapiens
  Payload ID: 2450
  Gene Symbol: CTSB
  Gene Name: cathepsin B
  ENST ID: ENST00000531551
  CDS Start-End: 154-486
gcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaa

SEQ ID NO: 115006 - DNA, 560 bp, Homo sapiens
  Payload ID: 2450
  Gene Symbol: CTSB
  Gene Name: cathepsin B
  ENST ID: ENST00000526195
  CDS Start-End: 115-560
ctcctcttagaaatcctgacgcagctcctaggttccttcgcagtgacagccactcttttctatttgtacgtagctgtagtgttttgtgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacgg

SEQ ID NO: 115007 - DNA, 660 bp, Homo sapiens
  Payload ID: 2450
  Gene Symbol: CTSB
  Gene Name: cathepsin B
  ENST ID: ENST00000526481
  CDS Start-End: 1-231
tcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcgggagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattcccctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 115008 - DNA, 1921 bp, Homo sapiens
  Payload ID: 2451
  Gene Symbol: CTSC
  Gene Name: cathepsin C
  Uniprot ID: P53634
  ENST ID: ENST00000227266
  CDS Start-End: 116-1507
ggtttccgggccggcgtagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 115009 - DNA, 6125 bp, Homo sapiens
  Payload ID: 2451
  Gene Symbol: CTSC
  Gene Name: cathepsin C
  Uniprot ID: P53634
  ENST ID: ENST00000524463
  CDS Start-End: 90-503
aaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgatttttttctaagattgtcaggatttgaagtgtatgttttgttttattcacagcgtaaattttattcacagtttaactgtctgcctgagtgtctttcctttctctaattaccttgaggaacccaagagcctgttgtaaggagaaaataaggcccttggatctcttgagattcacagatataagttattgaagggaagatggtcctatggaggacatatttaaagaagggaaaaaagaggctttctcagatatgtcagactgctatagtatacttctacagattatagacctccagtacctctggccagaaagatggtatcgtaaacaccctattttttttcttttcttttttcattaggtacaagctttgtgctaagaagttgacatactataagctacaaaagttctgtaaagtagatataactagtttcattttatagatagagaaaattaatctcttacagtgctaagctcacagagtttctaactgtaaaatgctagaacttgtctttcaagcctaaagacttccttggggctaaatagtgaaaaaagccatttcacaaataagtaaatggtatttagaggcatatttggatttcctggtaaattccagtctgtgagcatcatgaatattagtttaatgttgcatgggctcatgttgaagttttaagagaagaactgccttgaagcttaggtttccttagctattaggctactgactttcttgcctaaaccagggttttttcattgaagaccaaaacttaccttctccttcagtttgtagtttggaaattggtagaagagctttgtaaacttcaaattaagtacaaactaagtgtcatagtcaaatttactaatcttaattacagtattgttcaactgattgctatcttctagctctttcctgccgaataatggtcttgtttcctgctctgttggtttagagctgacttctttcagctttggtaagcctgaaattatggggttatgtttaattcatattgtctgggtggactttcctctcttgcatttctgcttgaatagaagaatttttctctagagagtagtttgtcatccttactctgttgattcagatgactctttgtatgatctgagaggtatactgttctgctattctgagaagaagtatttcagaaagatgaattaagagtacagtggactgctcccacctggaaacttttatctatctcacctctggacctgataaattctttatcactcaggaccttgatgacgctgctctctgaaaccctccccagctctctctattaccgtgagaaacatcagaactttggttcccattgcatatcgcaggtacctctgctttcatgccatgctgtaatggagtgattgggtagcatgttttcatctctttccagattgaaaatctgtatttctccctgtatatcttcaacacctaatgcacatagaactttgtaggtacctggaaaatgcaccacagttttcttttctttttgcagacttttcacaagtattaccaacttacaaagaattaattttgtaggattctagaaagacaaatcaggaatggtgccatatacatcttttttgattccctgctctaaagaatattatcaggttaccttcctgcagagttttaaaagaattgcatatttcaagctgactttcaggatgtaaatataaccaaagcaactgatatgtaaaaaatatattcaatggcattcctagattttcttctagggtgttttattgttttgggttttacatttaagtctttaatccatcttgagttaatttttgtataggtataagaaaggggtccagttttaattttctgcgtatggctagccagttctcccagcaccatttattaaatagggaatcctttccctattgtttgtttttgtacggtttgtcaaagattagatggttgtagatgtgtggtcttatttctgagatcttcattctcttccactggtctatgtgtctgtttttgtaccatgcttttttggttactgtagccttgtagtatagtatgaaagatagcatgatgcctccaggtttgttctttttgcttaggattgtcttggctatacgagcttttttttggttctatatgaattttaaaatagtttcttctaattgtgtgaagaatgttaatggtagtttaatgggaatagcattgaatctgtgaattgctttgggcagtatggccattttcatgatattgattcttcctatccatgagcatgtaacgtttttcccttcgtttgtgtcctctctcatttccttgagtagtggtttgtagttctccttgaagagatccttcacttcttctgtattcctagatattttattctctctgtagctattgggaatgggagttcattcatgattttgctctctgcttgccttttgttggtgtatagggatcctggtgacttctgcacattgattttgtatcctgagactttaccgaagttgcttatcagcttaagaagcttttgggctgagatgatggggttttctagatataggatcatgttatcttcaaacaaagacaatttgacttcctctcttcctatttgagtacgctttatttctttctcttgcctgattgccctggccagaactcccaatactatattgaataagaatggtgagagagggcatccttgtcttgtgccagttttcacggggaatgcttccagcttttgcccattcagtatgatattatctgtgggtttctcataaaaagctcttattatttgagatacgttccttcaatacctagtttattgagagtttttaacatgaagcgatgttgaattgtatcgaaggccttttctgtgtctattgagataatcatgtggtttttgtctttagttctgtttatgtgatgaatgacgtttattgatttgcatatgttgaaccggccttgcatcctggggatgaagccaacttgactgtggtagataagcttttggatgtgctgctggatttggtttatcagtatttcattgagattttttgcgtcgaagttcatcagggatattggactgaagttttctttttgttgtcgtatctctgccaggttttggtatcaggatgatgctggcctcataaaatgagttagggaggagtccctccttttcaattgtttggaatagtttcagaagaaagggtatcagctcctctttgtacctctggtagaattcaactgtaaatccatctggtcctggactttttttcattagtaggctatttattactgcctcactttcataacttgttattgatctattcagggatccaacttcttcctgattcagtcttgggagtgtgtatgcatccaggaatttatccatttcttctagattttctagtttctttgcatagaggtgtttgtagtatttgctgttggttgtttgtacttctgtgagatcagtggtggtatcctgtttatcattttttattgtgtctgtttgattcttctcttatttttgacaaagctgacaaaaagaagcaatagggaaaggactctctattcaattaatcctactgtatatctggctagccatatgcagaaaattgaaactgttcctgtttcttaatccatatacgaaaatcaacttacgatggattaaagacttaaatgtaaaacccaaaattataaaaccctggaatagaatataggcaatatcattctggacataggaatgggcaaagattttatgagaaagacaccaaaagcaattacaacaaaagcaaaaattggcaaatgagatctaattaaactaaagagctctgcacagcaaaagaaactactgtcagagtgaacaggcaaccaacagaatgggagaaaattttttcaatctatccatatgacaaaggtctaacatccagaatctacaaggaacttaacaaatttacaagaaaaaaggagccccattaaaaagttggcaaagaacatgaacagacacttcccagaagatattcatgtggccaataaacatgaagaaaagctcaacatcactgaccattagagacgtgcatatcaaaatcacaatgagataccatctcatgtcacaatggtgattattaaaaagtcaaacaacatgctagtgaggttgtagagaaataagaacgcttttacactgttggtgggaatgtcaactaattcaaccactgtggaagacagtgtggtgattcctcaaggatttagaaccagaaatatcattactgcatatagacccaaaggaatagaaatcattctattacaaagatacatgcacatgtatgtttattacagcactattcacaatagcaaagacatggaatcaacccaaatgctcatcagtgatagactggaaaaagagaatgtggaacataaacaccatggaatactatgcagcaataaaaaggaatgagatcctgtccttttcagggacatggatggagttggaagctgttatcctcagcaaactaatgcaggaacagaaaaccaaccaccacatgttctcacttataagtgggagctgaacaatagaacacatgggcacagggaggggaataacacacactggggccagtcagggggtggggggtcaagctgagggagagcattagaaaaaatagctaatgcattctgggcttaacccatttatgcctagtgttccatttctggaatgctaagcatgtggaagttctttatatcctgctcaaggtcattgccaaggtctgatttttcacattcaacaaattgcaacctctggcataaatgggttaatacctaggtgatgagttgataggtgcaggaaaccaccatggcacatgtttatctatgtaagaaacctgcacatcctacacatgtaccctggaacttaaaaaatttaaaatatatatgtatatatatttaatatggaattttaaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaatata

SEQ ID NO: 115010 - DNA, 733 bp, Homo sapiens
  Payload ID: 2451
  Gene Symbol: CTSC
  Gene Name: cathepsin C
  ENST ID: ENST00000527018
  CDS Start-End: 1-733
tcgtggtggactcaccgctagcccgcagcgctcggcttcctggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggt

SEQ ID NO: 115011 - DNA, 401 bp, Homo sapiens
  Payload ID: 2451
  Gene Symbol: CTSC
  Gene Name: cathepsin C
  ENST ID: ENST00000528020
  CDS Start-End: 1-110
aggatgtcactgattttatcagtcatttgttcatgcagctgggaactgtggggatatatgatttgccacatctgaggaacaaactggccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaaca

SEQ ID NO: 115012 - DNA, 747 bp, Homo sapiens
  Payload ID: 2451
  Gene Symbol: CTSC
  Gene Name: cathepsin C
  Uniprot ID: P53634
  ENST ID: ENST00000529974
  CDS Start-End: 62-487
gctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttc

SEQ ID NO: 115013 - DNA, 2123 bp, Homo sapiens
  Payload ID: 2452
  Gene Symbol: CTSD
  Gene Name: cathepsin D
  Uniprot ID: P07339
  ENST ID: ENST00000236671
  CDS Start-End: 134-1372
gcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgt

SEQ ID NO: 115014 - DNA, 907 bp, Homo sapiens
  Payload ID: 2452
  Gene Symbol: CTSD
  Gene Name: cathepsin D
  ENST ID: ENST00000367196
  CDS Start-End: 309-907
ttcacaccaaggggaaggccagtggccctgggggaggagcagggacccctctctctcttactcgcttcctgggtttagaactcaggaccccgatctcagtctggagctccctcctgcaccctggctggcggtgtgctgggtgacaggactctggaggggtaccctgagtgcagctgtcggaggaggcagggcggtggggggggcagcacagaagcctctaaggccccaggtgcagtcctggacctcgtggagccgcatggagtgaggagaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcag

SEQ ID NO: 115015 - DNA, 690 bp, Homo sapiens
  Payload ID: 2452
  Gene Symbol: CTSD
  Gene Name: cathepsin D
  ENST ID: ENST00000429746
  CDS Start-End: 1-570
aatgtcacccgcaaggcctactggcaggtccacctggaccagagccctgaggggaggagagtgcagcccagccaggggaggggctcccagggaggggcactgggcccccagggcacactccagtcccggcaggggcttcacgccctgactccccgcagggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgcc

SEQ ID NO: 115016 - DNA, 2006 bp, Homo sapiens
  Payload ID: 2452
  Gene Symbol: CTSD
  Gene Name: cathepsin D
  ENST ID: ENST00000433655
  CDS Start-End: 43-873
cgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccagtgagtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttg

SEQ ID NO: 115017 - DNA, 946 bp, Homo sapiens
  Payload ID: 2452
  Gene Symbol: CTSD
  Gene Name: cathepsin D
  ENST ID: ENST00000438213
  CDS Start-End: 50-946
atgtgcagcattggcagcgtcggccggcaggcgggagggcctccctgatatgccccgacccgtggttgacaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggcc

SEQ ID NO: 115018 - DNA, 2228 bp, Homo sapiens
  Payload ID: 2453
  Gene Symbol: CTSE
  Gene Name: cathepsin E
  Uniprot ID: P14091
  ENST ID: ENST00000358184
  CDS Start-End: 119-1309
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttta

SEQ ID NO: 115019 - DNA, 2071 bp, Homo sapiens
  Payload ID: 2453
  Gene Symbol: CTSE
  Gene Name: cathepsin E
  Uniprot ID: P14091
  ENST ID: ENST00000360218
  CDS Start-End: 105-1196
agactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcatttt

SEQ ID NO: 115020 - DNA, 2035 bp, Homo sapiens
  Payload ID: 2454
  Gene Symbol: CTSF
  Gene Name: cathepsin F
  Uniprot ID: Q9UBX1
  ENST ID: ENST00000310325
  CDS Start-End: 111-1565
gtgccgtcgccccgctggagggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggtcaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgtgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgag

SEQ ID NO: 115021 - DNA, 846 bp, Homo sapiens
  Payload ID: 2454
  Gene Symbol: CTSF
  Gene Name: cathepsin F
  ENST ID: ENST00000524994
  CDS Start-End: 1-846
ccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgaggaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgct

SEQ ID NO: 115022 - DNA, 609 bp, Homo sapiens
  Payload ID: 2454
  Gene Symbol: CTSF
  Gene Name: cathepsin F
  ENST ID: ENST00000525733
  CDS Start-End: 1-247
ccgcactatctacctgaatactctcctgaggaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgtgagttccgctgcctgtcct

SEQ ID NO: 115023 - DNA, 548 bp, Homo sapiens
  Payload ID: 2454
  Gene Symbol: CTSF
  Gene Name: cathepsin F
  ENST ID: ENST00000526010
  CDS Start-End: 188-548
tttaatctctccaagcctcgtttcctccactgtacgatggggatagcacctacttcagagattgctacgccgaataaaaggagctggcatatcatgcctaacatataacaagcacgtgatagaggcgggtcaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtca

SEQ ID NO: 115024 - DNA, 886 bp, Homo sapiens
  Payload ID: 2455
  Gene Symbol: CTSG
  Gene Name: cathepsin G
  Uniprot ID: P08311
  ENST ID: ENST00000216336
  CDS Start-End: 38-805
gcacagcagcaactgactgggcagcctttcaggaaagatgcagccactcctgcttctgctggcctttctcctacccactggggctgaggcaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaagcaatataaatgtcaccctgggcgcccacaatatccagagacgggaaaacacccagcaacacatcactgcgcgcagagccatccgccaccctcaatataatcagcggaccatccagaatgacatcatgttattgcagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataacc

SEQ ID NO: 115025 - DNA, 2190 bp, Homo sapiens
  Payload ID: 2456
  Gene Symbol: CTSH
  Gene Name: cathepsin H
  Uniprot ID: P09668
  ENST ID: ENST00000220166
  CDS Start-End: 111-1118
tcccgccgctcctccacgctcgtgccgctccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaaccggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatggagcatgctggtcctgggccatgactcaaaccaggtctgtcctcgccactcagtctcccaggagggaggcatcagggggtgtccaggctctggctgggaggatggtgggggtgctggcggtattatccaccagatggggtatccaggatgaagagcaggcttaatttgagatcttgactatttgtcccaaacctgagtggagaggtggggaggaaggagaaaaacgggccaagctgcggcagaggcaggattcaaacccacaatgtcagcccagaagcctgtacttctctgtgtggcctccccagtctcagctgcctactcctactcagactctgccccccacctccacatgagactgcccaccccttcctcaccaaccccttatttatttcaaacgtgcccagatgctcctgtcgtttccacaccatcccttcccttatcttgccttttgagaaatcttgatctctgtttagagggcggccatgaagttgctgctgcttcctgaagcctccgggctctgggatgtctgtagaacaagctggagtccaccagctctttgtcctatggctcacagactttcttaatgataaaagctgtcatcttatttgggcttcctgaaaagctaaaggcttgagaatatttgaaaaatatatatgttcatgataaggcttatttagataatgcaaatatagtttaatttattagaaaa

SEQ ID NO: 115026 - DNA, 2101 bp, Homo sapiens
  Payload ID: 2456
  Gene Symbol: CTSH
  Gene Name: cathepsin H
  ENST ID: ENST00000533777
  CDS Start-End: 66-254
agttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagagaagtttcacttcaagtcatggatgtctaagaaaaccaaagcacactgtgtactggttgcagaatcagttggggaacaccagtgcatgtgcttttgaaaaatggtgatctttgctgtaaacttgacccagcaccagcagtggcgtccaggagtgccccacatgtggcagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttgcagcctcagttgtcttcatgagggaagagccgggacctatgcatccatcccctcgcccacaagagacggatgatgcccctgaaggaactatcctagcccctgcctctgtggagaaaggagggacagtgcacagccggcctggtgatgccatgaggaccctgggttgtggacaggtgggggtagggtctctggctgggcctgtttcccccatcctatacaccgctgtgggaccccacactctgcatcgtatgggcacacctacggggcaggggtttggacccaacagcccttgccccctctcaccttccctggctgcccctgcttactgagcccctcccgacatgtgccagctgctgggctggcactgcaggacatacagcaactgtccctgcccttggggagtttataatttggtcaccttgacacagcactgacggggcctcagatgtggctcagccagggaggcttagcgcctcacgccaaagccttgacggcttctcagctggcaggtcactgggttgtgtccttcttccaggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaaccggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctc

SEQ ID NO: 115027 - DNA, 857 bp, Homo sapiens
  Payload ID: 2456
  Gene Symbol: CTSH
  Gene Name: cathepsin H
  ENST ID: ENST00000529861
  CDS Start-End: 114-239
cgctcccgccgctcctccacgctcgtgccgctccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttaggtacgcagagggcgcgccgcccgagagggtgctagcaggccctagagtggacgctgggagaacttggccaggggcgcactgggctccggaggaacggggcagagctttccccgagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaagg

SEQ ID NO: 115028 - DNA, 1122 bp, Homo sapiens
  Payload ID: 2456
  Gene Symbol: CTSH
  Gene Name: cathepsin H
  ENST ID: ENST00000525807
  CDS Start-End: 82-438
ccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaaccggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccaga

SEQ ID NO: 115029 - DNA, 719 bp, Homo sapiens
  Payload ID: 2456
  Gene Symbol: CTSH
  Gene Name: cathepsin H
  ENST ID: ENST00000528741
  CDS Start-End: 318-719
attcatgcaggaggcattctgcatgcaggcagtgactgcagattccaggacctgtggttagcggactcctattgatgtttctgggaactctagacctggaagttcagagaagtttcacttcaagtcatggatgtctaaggaaaacaaaaaggtctccctctagggagctgcagcctgtttccatgacttgctactggcgtgttttgttttagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaag

SEQ ID NO: 115030 - DNA, 972 bp, Homo sapiens
  Payload ID: 2456
  Gene Symbol: CTSH
  Gene Name: cathepsin H
  ENST ID: ENST00000615999
  CDS Start-End: 1-972
atgtgggccacgctgccgctgctctgcgccgccgaactgtgcgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaaccggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtga

SEQ ID NO: 115031 - DNA, 1692 bp, Homo sapiens
  Payload ID: 2457
  Gene Symbol: CTSK
  Gene Name: cathepsin K
  Uniprot ID: P43235
  ENST ID: ENST00000271651
  CDS Start-End: 112-1101
gatcactggagctgacttccgcaatcccgatggaataaatctagcacccctgatggtgtgcccacactttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcagttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatctcctgtctacagtttaataaatagcatctagtacacattca

SEQ ID NO: 115032 - DNA, 785 bp, Homo sapiens
  Payload ID: 2457
  Gene Symbol: CTSK
  Gene Name: cathepsin K
  ENST ID: ENST00000443913
  CDS Start-End: 11-785
ggaagaagaaatgcataaggagaatgaggagatatacaatgtctcagaaaacaggaaacattgtcctattttcccttgtcctcttctgacaagatctgggaaagtaccagaatttaggcacgaaagagaagaacgcctcgaagaaatgatcaggaggcaaaacttagacggaaatctctcctttgtgatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatg

SEQ ID NO: 115033 - DNA, 933 bp, Homo sapiens
  Payload ID: 2458
  Gene Symbol: CTSL
  Gene Name: cathepsin L
  ENST ID: ENST00000342020
  CDS Start-End: 125-802
ttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttaagagataacagatacctttttcggaattcatatattagggctgggtggggtggctcacgcctgtaatcccagccctttaggaggctgagccaggcagatggcttaagctcaggagtttgagaccagcctggg

SEQ ID NO: 115034 - DNA, 2177 bp, Homo sapiens
  Payload ID: 2458
  Gene Symbol: CTSL
  Gene Name: cathepsin L
  Uniprot ID: P07711
  ENST ID: ENST00000343150
  CDS Start-End: 891-1892
agccagtctcctccctcctagggtctggtcttgacgatagcatctcgtgttttggggatgcctttccttaccagattcttctaaagcccagctgcacccacccttaagtgggagataaggcttctgcccgcgggctctgcgttcgtccacccggccccacgtttgctgtggactaaacaggagccactggactagagtacacttgactctcggctctgcggaccaaaaattccaggactaaggaatagcaaggttaggctgaaacagtccacacagggcttgcggtaaacgtcttttcaggagccactcgcccagtgcagtaagtcgtgtacttagttgactcgagcgctccagggagacgcccgaccctactctgcgccgccccggggcaccagctctgcttcctccaggtccactgaggcaggcacgcccagctctgggacagtcagtaaacaagccacgaaccgcgccagggatcagagcacccagagtccccgcccagctgccggcacagccaatcgcagcgcagccaggcggcggggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 115035 - DNA, 1436 bp, Homo sapiens
  Payload ID: 2458
  Gene Symbol: CTSL
  Gene Name: cathepsin L
  Uniprot ID: P07711
  ENST ID: ENST00000340342
  CDS Start-End: 156-1157
aagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttc

SEQ ID NO: 115036 - DNA, 2954 bp, Homo sapiens
  Payload ID: 2459
  Gene Symbol: CTSO
  Gene Name: cathepsin O
  Uniprot ID: P43234
  ENST ID: ENST00000433477
  CDS Start-End: 71-1036
aggctgggaggagccgaggaaccgaaagagaaaacaggccgcgcgggcggcagaggagccgggcgccgcaatggacgtgcgggcgctgccgtggctgccgtggctgctgtggctgctgtgccggggcggcggcgatgcggactcccgcgcccccttcaccccgacctggccgcggagccgcgagcgtgaagccgccgccttccgggaaagtcttaatagacatcgatacttgaattctttatttcccagtgaaaactccaccgccttctatggaataaatcagttttcctatttgtttcctgaagagtttaaagccatttatttaagaagcaaaccttccaagtttcccagatactcagcagaagtacatatgtccatccccaatgtgtctttgccgttaagatttgactggagggacaagcaggttgtgacacaagtgagaaaccagcagatgtgtggaggatgctgggccttcagcgtggtgggggcagtggaatctgcttatgcaataaaggggaagcccctggaagacctaagtgtccagcaggtcattgactgttcgtataataattatggctgcaatggaggctctactctcaatgctttgaactggttaaacaagatgcaagtaaaactggtgaaagattcagaatatccttttaaagcacaaaatggtctgtgccattacttttctggttcacattctggattttcaatcaaaggttattctgcatatgacttcagtgaccaagaagatgaaatggcaaaagcacttcttacctttggccctttggtagtcatagtagatgcagtgagctggcaagattatctgggaggcattatacagcatcactgctctagtggagaagcaaatcatgcagttctcataactgggtttgataaaacaggaagcactccatattggattgtgcggaattcctggggaagttcttggggagtagatggttatgcccatgtcaaaatgggaagtaatgtttgtggtattgcagattccgtttcttctatatttgtgtgacatgttgggcagatcaagagacagctacaaaaatgaaggttttcataatgcaatgtaacatagtacttcaaagtattattcaacttcaagtttcagcaactacctacaaaagattctaaggcctagtagtatttaaactaagtttcagaatgttcccttcttgtagagagatggacaaccaaagtcagtgggacaaactccagcacagaagcctgcgaggaagcctatggaatagtttcctgtcctgagacgaaattcagattaggagatattttaggcccctgcaactggggaaggctactgtttgtttttgtttgcttattatttatttgtttgtttattgtgagatatttcaggtgggatcaaagaggtcataagaatttattttcttttgtggggtgtaactactagctttagattacccctatacacaagaatggccaacctaaaattatgtgtgtcttgtacagttagttatattagcagccctctgagatggcgtatctatcggaaggatttcaaacaccaattgctttacctgaacaaatggtgcttaccctttgaacagcagagtgaccacgtagaaggaaggaaaagggcaaaatcgcttcagttaaactgaaattaaatgaacaataaggcaactatataagtaacttctagtagcattgcctgagagacaaattattgtttgataattttcattgtgaataggaatccaatagatcatattgcttactttgttctttttatactatagaataatattttgttctctagtatatcaaaataccaaaatattatctcatattttctccctctttctcttactctttaccaagttttcctggtggcttggcttccctgactaaagaattaagtctcatttttactttccatttctattttcttaccacttggttggctccctttgtctctgtacctttaccaacattaggatctcacctctttcttcctcccttaattcataagcaccactcctatcaaagtcccatctcttaaccctgggtatcaaacaaactgtgagttttccagaatctgtttcccagttttcccctcagctttcctggtctcccatccgaactgcttctttgtgcacctcttgttctttctcttggctcccagtcttgattcctgtgatcactcttgcatcactaattgcacaagtgatttcaggtgcaattctgattagcctgcgtccacacagtgatcgatgatcctatgtgcctagaaaggacactgtgtgctgctcatgacctgcaacaggaaaaaagccatttcttgttagcagtgtaagaaccttagagcaaaggagttgaccttctgattgaatataagcacaaccatattaaatgaatcaatacaagaaaattatttctgatactatgtatgtacatatttcttctctaaaatgtatcattcttttctaatgtatatgatctaacaaaaatgaaacatgaaatgcagtagcaaccactaaaaaaaaaaattcaaggacatctaactttttctctcacttttgccctttgtttatccttccctgtgattagataaacaaaataaaaaacaaaatgctgtatttctcttcttacgccagtcagaaccaatccgaaaagaatgtgtgttgactcaggtttggagttatttcaggaagacagatattgaccttttaattgataaatattcttattatcctggaatgccagaaaagaactatgtcctgcttgtctagtttgtattcgctgactttctatgtgatatagatgcatttgtaatactctttttcaagtgctaaaggatttctaaaatttcaaactgattaatatgtttctgctgttctggattttgatgacatttacaataaaacaacctacatttgactttggtttaaaaagaa

SEQ ID NO: 115037 - DNA, 2954 bp, Homo sapiens; identical to SEQ ID NO: 115036
  Payload ID: 2459
  Gene Symbol: CTSO
  Gene Name: cathepsin O
  Uniprot ID: P43234
  ENST ID: ENST00000573499
  CDS Start-End: 71-1036

SEQ ID NO: 115038 - DNA, 4107 bp, Homo sapiens
  Payload ID: 2460
  Gene Symbol: CTSS
  Gene Name: cathepsin S
  Uniprot ID: P25774
  ENST ID: ENST00000368985
  CDS Start-End: 262-1257
gacaagggctcttcttgatggcttactgtatccactttgtccccaagaccatagggaaatgactagaggtgactgtactagctagattttaaatgaaactgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtaatcccaacactttgggaggctgaagtaggaggatcgtcttgagcccaggagttcaagaccagcctggacaacatagtgagaccttgtctccacaaaaataaaaaagaaactatccaggagtggtggtgtgtgcctgtggtccctgctatgcagatgtctaagacaggaggatcacaagagcccaggaggttgagaatgcagtgagcttgtaattgcaccactgcactccagcctgggtgacagagcaagaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcactctgttgcccaggctggagtgcagtggcaccatctcagttcactgcaacttctgcctcccgagttcaagcgattctcctgcctcagcctcccgagtagctggaattataggcgtgcaccaccacgcccagctaatttttgtatttttagtaaagacagggttttgccacattagccaggctggtctcaaactcctgacctcaggtgatccacccaccccagcctcccaaagtgctaagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttt

SEQ ID NO: 115039 - DNA, 1421 bp, Homo sapiens
  Payload ID: 2460
  Gene Symbol: CTSS
  Gene Name: cathepsin S
  Uniprot ID: P25774
  ENST ID: ENST00000448301
  CDS Start-End: 97-942
aattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctca

SEQ ID NO: 115040 - DNA, 673 bp, Homo sapiens
  Payload ID: 2460
  Gene Symbol: CTSS
  Gene Name: cathepsin S
  ENST ID: ENST00000472977
  CDS Start-End: 1-289
tgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatataattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaa

SEQ ID NO: 115041 - DNA, 390 bp, Homo sapiens
  Payload ID: 2460
  Gene Symbol: CTSS
  Gene Name: cathepsin S
  ENST ID: ENST00000607427
  CDS Start-End: 1-17
cttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatata

SEQ ID NO: 115042 - DNA, 752 bp, Homo sapiens
  Payload ID: 2460
  Gene Symbol: CTSS
  Gene Name: cathepsin S
  ENST ID: ENST00000483930
  CDS Start-End: 1-354
atcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtgatggagtcttgctctgttgccaggctggagtgaggtggcacgatctcagctcactgcaacctctgcctcctgggttcaagcaattctcctgcctcagcctcctgagtagctgggactacaggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggc

SEQ ID NO: 115043 - DNA, 1546 bp, Homo sapiens
  Payload ID: 2461
  Gene Symbol: CTSV
  Gene Name: cathepsin V
  Uniprot ID: O60911
  ENST ID: ENST00000259470
  CDS Start-End: 251-1255
ggtaggcgcgcccagacctgagacgggttgggactgggctgcgtcacgcgcgggctctaagcgcccggggccccgcccagtggccggcacagccaatcgcagcgcgggaaggcggtgggggcggggaaggccgcctggaaacttaaatcccgaggcgggcgaacctgcaccagaccgcggacgtctgtaatctcagaggcttgtttgctgagggtgcctgcgcagctgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatat

SEQ ID NO: 115044 - DNA, 4322 bp, Homo sapiens
  Payload ID: 2461
  Gene Symbol: CTSV
  Gene Name: cathepsin V
  Uniprot ID: O60911
  ENST ID: ENST00000538255
  CDS Start-End: 48-1052
cttctaaagccctgatgcacccacccttaagtggaaggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaaggtgggcctttttttaatgcattggctttttgtgtagtcaggaaatataattaagctctgaaataataacttcatgtgccaatggtatgttaggagaaagatgctagcagaaagctggcttcctggctcttgagtagttataaaaatacagactttatatcagctgcccagttactgtgtgttacccaactcctgaatctaccaaaatttgataaacaatttggaaggacaaacctacattttttttttttatgagacggagtctctctcactctgtcaccaaggctggagtgcagtagtgtgatctcagctcactgcaacctctgcctcccgggtttaagcaattctctgcctcagcctcccgagtagctgggattacaggcgcgtgccaccacgcctagtgtatttttagtagagagagggtttcaccatcttggccaggctggtcttgaactctcgacctcgtgatccacctgcctcagcctcccaaagtgttgggattacagatgtgagccactgcgcccagcccctaaattgttttagtaaagaagaaagcagttgactttttagaaaaggaaatgtcttcttcctttgacacataacctcaagatggttaggttacgtgataaaaagtgaagctgcttgttactggagcctctctgaattgctggtgaccactttgcagtctgaggaagacgcaggtgcaagtaagttaccaagggtattttgttttcattccaagtctctgatgacatattccacctagctcttctagaaaagcttatttgttaactagtgttagcaaaaataaatggtgtggttaacaaatctcaggcatttgacagtagctggagaaatttgttcaaggtccacaagagatgaggctgggctacaaaaagaggcctctggccgaagatggataagagatcacaagtgaaaggtcagaagtcactaggccagactctggctacctaatccctgaattaaaaataaactcaaaatggggggaaaaaggctaagcatatagttacacaggtagtaaatacaaataaaacgatatttttgcatatttaaaatactggaagaaagtacaccaaacttgtgggtgaattatgggtggttatttaactcgtttagtgaaaagcatgtatttttatgagcaggagaaaatagtaaagatatacccacattctgcaggctaaaggagagccctgtgtgtgttttaaaagcccatgtttccagtcaaataaaaaattaccggggatgagctggtgaaatttaatcgaaaggtgatccattgtgaatgcaatgggagggaaggggcatgtgggactgtgtatcccaaaaaccctttgatagcctatgtccacagccatctctggaaaatccagtctaccatattcagtcttgagttttctctgagaaaggattccttcgtctttgcagcagcaggctaagttggtactctccacagattcttggaacaacaacccaggctctaaggaaacatctaggcactaaattgaatgaaagagtgatggctttttattcaaataaaaaaatttcaaatctgtcaaaacagcacccctcggaaaactaaaatagagatatttcaagattttataattttcaaagacctttgaaatattttaaacttgtgaaaagttacaaacctgatgtgttgtctaaaagcgtttttcaaacaagccagtagacttgaaaaatctagtctgaagcacagacttaaccaatatttgctggggatatgcccccaaatctggccataaacaaaatctctgcagtactgtgacaggttcatgatggccatgacgccatgctgaaggtttaccggaatgagagcaaggaacacctggaccacccagggcgggaaaacggcttaaaggcgttcctaaactacaaacaatagcatgagcgatctgtgccttaaggacatgttcctgctgcagataactagccagaccccatgcctttgtttcgtttgggaaggaatacttttagttaatctataatctatagaaacaatgtttatcactggcttgctgtcaataaacatgggtaaatctctgttcggggctctcagctctgaaagctgtgagtcccctgatttcccactctgcatgctatatttctgggtgtgtgtctttaatttctctagcgcctctgggttagggtctccatgaccaagctggtctcggcaaatatttcctatactcgaacatctaaattgtttgttttcttacttgaattgcaaaggaagtaaggaagggtgagatagaaatcactgagcatattaagagggaggagtttgctgatgtgggagtgtagttatgacacttgggcatcatactagaggctatggacttagcaataaggaaacatccactcagccctatgtgtggttcatgtgtatgttttgcctatgaaagttgaaactgttttctaaatgttatttccttttgtaactgataaaatttctaaaaagcaaagaagaaacttttctgtattaaaaataacaaacattagtaaatgtatatatacagtcatgtgttgcttaatgatggggatacattctgagaaatgtgtcttgggtgatttcatcgtgacgtgaacatcatagagtacactgacacaaacctagatggtatagcctattacacacctaggctatatggtacagcctgttgctcctaagctacgcacctgtgcaacacatcactgtgctgagtactgtacacagttgtaacacagtggtaagtattcgtgtatctgaacagaaaagtacagtaaaaatataggatcataattttatgggaccactatcatatatgcagtcactgaccaaaacatcacacagcacatgacttgtgtgtatggatatctcaattgtaaacaatttcacaaatgttcattatctctttttaagtaagttaataagtaaaactattactaagctgc

SEQ ID NO: 115045 - DNA, 1300 bp, Homo sapiens
  Payload ID: 2462
  Gene Symbol: CTSW
  Gene Name: cathepsin W
  Uniprot ID: P56202
  ENST ID: ENST00000307886
  CDS Start-End: 47-1177
gatctgcgcggcttcctgcctccatgccactccagactgcaccggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccagcgccatctcacccatcaaggaccagaaaaactgcaactgctgctgggccatggcagcggcaggcaacatagagaccctgtggcgcatcagtttctgggattttgtggatgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagacctctg

SEQ ID NO: 115046 - DNA, 634 bp, Homo sapiens
  Payload ID: 2462
  Gene Symbol: CTSW
  Gene Name: cathepsin W
  ENST ID: ENST00000526034
  CDS Start-End: 1-634
gcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccagcgccatctcacccatcaaggaccagaaaaactgcaactgctgctgggccatggcagcggcaggcaacatagagaccctgtggcgcatcagtttctgggattttgtggatgtctccgtgcagggcggcctggccagtgaaaaggactacccgttccagggcaaagtcagagcccacaggtgccaccccaagaagtaccagaaggtggcctggatccaggact

SEQ ID NO: 115047 - DNA, 1341 bp, Homo sapiens
  Payload ID: 2462
  Gene Symbol: CTSW
  Gene Name: cathepsin W
  ENST ID: ENST00000528419
  CDS Start-End: 5-1099
cggcatggcactgactgcccacccctcctgcctcctggccctgttggtggcaggcctagcccaaggcatcagaggcccccttagggcccaggacctaggtccccagccgctagagctgaaagaggccttcaagttgttccagatccagttcaaccggagttacctgagcccagaagagcatgctcaccgcctggacatctttgcccacaacctggcccaggctcagaggctgcaggaggaggacttgggcacagctgagtttggggtgactccattcagtgacctcacagaggaggagtttggccagctctatggctatcggagggcagctggaggggtccccagcatgggcagagaaataaggtctgaagagccagaggagtcagtacctttcagctgtgactggcggaaggtggccagcgccatctcacccatcaaggaccagaaaaactgcaactgctgctgggccatggcagcggcaggcaacatagagaccctgtggcgcatcagtttctgggattttgtggatgtctccgtgcaggaactgctggactgtggccgctgtggggatggctgccacggtggcttcgtctgggacgcgttcataactgtcctcaacaacagcggcctggccagtgaaaaggactacccgttccagggcaaagtcagagcccacaggtgccaccccaagaagtaccagaaggtggcctggatccaggacttcatcatgctgcagaacaacgagcacagaattgcgcagtacctggccacttatggccccatcaccgtgaccatcaacatgaagccccttcagctataccggaaaggtgtgatcaaggccacacccaccacctgtgacccccagcttgtggaccactctgtcctgctggtgggttttggcagcgtcaagtcagaggaggggatatgggcagagacagtctcatcgcagtctcagcctcagcctccacaccccaccccatactggatcctgaagaactcctggggggcccaatggggagagaaggtgagtgtgatctattgggggagggggcaaggcagaacaggcctcttcccaccttcccgcccctatgtcccctaacctcctagggctatttccggctgcaccgagggagcaatacctgtggcatcaccaagttcccgctcactgcccgtgtgcagaaaccggatatgaagccccgagtctcctgccctccctgaacccacctggccccctcagctctgtcctgttaggccaactgcctccttgccagccccacccccaggtttttgcccatcctcccaatctcaatacagcctgaataaaccaagacaagacctctg

SEQ ID NO: 115048 - DNA, 1495 bp, Homo sapiens
  Payload ID: 2463
  Gene Symbol: CTSZ
  Gene Name: cathepsin Z
  Uniprot ID: Q9UBR2
  ENST ID: ENST00000217131
  CDS Start-End: 120-1031
ggggtcggccgggtgctgggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggctccgctggggcgcagcacatacccccggcctcatgagtacctgtccccagcggatctgcccaagagctgggactggcgcaatgtggatggtgtcaactatgccagcatcacccggaaccagcacatcccccaatactgcggctcctgctgggcccacgccagcaccagcgctatggcggatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccaggagtgtgacaagtttaaccaatgtgggacatgcaatgaattcaaagagtgccacgccatccggaactacaccctctggagggtgggagactacggctccctctctgggagggagaagatgatggcagaaatctatgcaaatggtcccatcagctgtggaataatggcaacagaaagactggctaactacaccggaggcatctatgccgaataccaggacaccacatatataaaccatgtcgtttctgtggctgggtggggcatcagtgatgggactgagtactggattgtccggaattcatggggtgaaccatggggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggcactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgaga

SEQ ID NO: 115049 - DNA, 2619 bp, Homo sapiens
  Payload ID: 2464
  Gene Symbol: CATSPER1
  Gene Name: cation channel, sperm associated 1
  Uniprot ID: Q8NEC5
  ENST ID: ENST00000312106
  CDS Start-End: 139-2481
acgagaatagtcaggcctttctggaagcccagtgccacagtctgcattgagcttggctcaggaaagaagggaaatccaggcggggcctgttgggcccaggtcttgagctcttttggctccagagttcccagcacagtcatggatcaaaactcagtgcctgaaaaggctcagaatgaggcagacaccaataacgcagataggttctttcgctctcactcatcacccccacaccacaggccaggccacagcagagctctccaccattacgagttgcaccatcacggcgtgccccaccaacgtggtgaatctcaccaccctccggagttccaagacttccacgaccaagccttgtcctcccatgtccaccaatctcaccaccacagcgaggcacggaatcacggcagagcccatggccccacaggctttggtctggctccctctcaaggcgccgtcccctcccaccgttcctacggtgaggactaccatgatgagctccaacgtgatggcaggaggcatcatgatgggtcccaatacggtgggttccatcagcagagtgactcccattaccatagggggtctcaccatggcagaccccaatatctcggtgagaatttatcccactattcctctggcgtgccccaccacggtgaggcttcccaccatggtgggtcctacctcccccatggacccaatccctacagtgagtccttccaccacagcgaggcttcccaccttagcgggctccaacacgatgagtcccagcatcaccaagtcccccaccgtggctggccccaccatcaccaagtccaccaccatggcaggtcccgtcatcatgaagcccaccagcatggaaagtctcctcatcacggagagaccatttcccctcattcctctgtggggtcctaccagcgtgggatatctgactatcacagcgagtaccaccaaggtgatcaccaccccagtgagtaccaccatggcgaccatccccaccacacacagcaccactaccaccagacccaccggcaccgagactaccatcagcaccaagaccaccacggcgcgtatcattccagttacctccatggcgactacgtccagagcacttcccaactctctatcccacacacatcccggagcctgattcacgatgcccccggccctgctgcttctcgtacaggagtcttcccctatcacgtagcacacccacggggctcggctcacagcatgactcggtcctccagcacaatccgctcacgtgtcacccagatgtccaaaaaagtccatacccaggatatctccaccaaacattcagaagactggggcaaagaagaagggcaatttcagaaacgcaaaaccggccggctccagcggacccgcaagaagggacactctaccaatctcttccagtggctgtgggaaaagctaaccttcctcattcagggcttccgggaaatgatccggaacctgacccaatccttggcctttgaaactttcatcttcttcgttgtctgcctcaacaccgtcatgctggtggcccagaccttcgctgaagtcgagatccggggcgagtggtacttcatggccttggactccatattcttctgcatctacgtggtggaagccctgctcaagatcatcgccctgggcctctcgtacttctttgacttctggaacaatttggacttcttcattatggccatggccgtgctggacttcttgctgatgcagacccactccttcgccatctaccaccaaagcctcttccggatcctcaaggtcttcaagagcctgcgggccctgagggcaatccgggtcctgcggaggctcagcttcctgaccagcgtccaggaagtgacagggaccctgggccagtccttgccgtccatcgcagccatcctcatcctcatgtttacctgcctcttcctcttctccgcggtcctccgggcactgttccgcaaatctgaccccaagcgcttccagaacatcttcaccaccatcttcaccctcttcaccttgctcacgctggatgactggtccctcatctacatggacagccgtgcccagggcgcctggtacatcattcccatcctcgtaatttacatcatcatccagtacttcatcttcctcaacctggtgattactgtcctggtggatagcttccagacggcgctgttcaaaggccttgagaaagcgaagcaggagagggccgcccggatccaagagaagctgctggaagactcactgacggagctcagagctgcagagcccaaagaggtggcgagtgaaggcaccatgctgaagcggctcatcgagaaaaagtttgggaccatgactgagaagcagcaggagctcctgttccattacctgcagctggtggcaagcgtggagcaggagcagcagaagttccgctcccaggcagccgtcatcgatgagattgtggacaccacatttgaggctggagaagaggacttcaggaattgaccccaggaggacaccagatacagacttcagcccctggcagtctgcccacctgggtgcactgggacgggtccccagatctgctggaatgattgtccgggccctgcagagcaggggccccaacagagtttttaaacccca

SEQ ID NO: 115050 - DNA, 1820 bp, Homo sapiens
  Payload ID: 2465
  Gene Symbol: CATSPER2
  Gene Name: cation channel, sperm associated 2
  Uniprot ID: Q96P56
  ENST ID: ENST00000321596
  CDS Start-End: 201-1793
gggctgtgggtaggggctagggccgggtcccggggtgagccgaaacctgggggtcgagcggggcggggaatggggcgcagtgaggctgggagccggccctgagctcgtcttgcataggggtagccaggctcggggcacctgagctggaggcggaagcgtgaaataaggactgagtgggcaaagagaacctgggctgagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagttcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgg

SEQ ID NO: 115051 - DNA, 1758 bp, Homo sapiens
  Payload ID: 2465
  Gene Symbol: CATSPER2
  Gene Name: cation channel, sperm associated 2
  ENST ID: ENST00000381761
  CDS Start-End: 15-1619
gagcgttgctccgcatggtcctgggctcagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggcca

SEQ ID NO: 115052 - DNA, 3898 bp, Homo sapiens
  Payload ID: 2465
  Gene Symbol: CATSPER2
  Gene Name: cation channel, sperm associated 2
  Uniprot ID: Q96P56
  ENST ID: ENST00000396879
  CDS Start-End: 114-1700
gttgctccgcatggtcctgggctgtgggggtagccaggctcggggcacctgagctggaggcggaagcgtgaaataaggactgagtgggcaaagagaacctgggctgagcagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggccaggcgtggtgaaaccctgtctctactaaaaatacaaaaaaattagctgggtgtggtggcagatgcttgtaatcatagctacttgggagcctgaggcaggagaatcacttgaacctgggagtcagaggttgcagtgagccaagattgcaccactgcactccagcctgggcaacagagtgagactctgtataagtgtcttataaatactcctgatagctgctcagtagtgtgaccctgagataagggatattgaaaggcataaggtcaagtaaaagagttagttcaagctgagtgtggtgatgtgtgcctctagtcccagctatgggctgaggcaggattgtttgaggcagggagttcgaggctacagcaagctaggatcatatcactgcattccagcctgggcaacatagcgagaccctatctctaaaaaagaacaaaacaagttagctcagatgccagtggagtctgtgctccttagctttctaccctttccacagctcctgaatctgactcatttcttgactttatcattatagcttccacccttcctgcaacctctactgcctgattagagtcctaattttaccctctccctccctgatgcataggtaaaggcccctctgtggagtaaggagatcttcagagctgttagtgtaactaattgagaagtattgtttccattgcgtgttccactcatgttgcttctcttgtgaaccattaactttaattggatattatttttacctgtttctggaccggaagtctctttatttcattttgccatagctcagggcagtgttcaaatcagtaagtgttgtacaggtttttagtgttagaagggatttcagagttaatctatctcccatcaaagcaggaacaccttttagaacatcactgaaaggaggattatccaggtaatgcttaatgtttctagttatttgggatttattatctagaagggatcccattccatcgttagaagacttaagtctttagacatgtttattattaaaaattatatcacttattgagtgtttaacatgtatgaggttatttatatatttagtatatatatactgtatatagagtatgcatatttcataaaataatcatatatggaagatagcgtcacatttttagagatcagaaaactaaggcctaaagaaattaagtaagttaagtagcttgcccaagagcacataccaagtaagaggtagagctaaggttctaactcaggttaaaaattctgagttgagaaaaaaatcagttgaagccatttaaacaataaaatagcttactggagactggaaaattcaaaggtagtatagcttcaggattgatttaatgtaaaaattcactgttgttagatctgtggttttgtttctctggaattttcctgtctgcgctctcctccacgtgttcttgttattctcagactggcttcacttgggtagccagacaattttctgaagcgcctaggcttgcatacctatttccccatatgcaggggaagagagccggtgactcctttctcagtcaatgaacaaaatttttgagctttgggtcacaataatggttattcttggagtgaagatactgatggggaggaagcatgaagcatctggagtgctatagatatgttccatatcttgatctgcatggtggttacaccggtatatacagatgtaaaaattcaacaaaatgtacacttaaaatttgggcattaactgcaggtaagtcaacctccactcctctaaagatatcctgaccaccactctgattggaccaagaagttaggtcatatgcttacgtctgaacaaattgttgaggtaaggtggtggttgtgatgaaatcactaattaaggctttctcctgaactggaggtaaggtcagtaacacccaaccttaagtaagggctgctacccaagtggggaagagatggaagggggcaatagggtggtaattataaagtcctcacctaagagtatgtctggcaaaaaggccaagatggggaaaaggcaaatgaattgaatgtccagaataaacaaatctatgaagaca

SEQ ID NO: 115053 - DNA, 568 bp, Homo sapiens
  Payload ID: 2465
  Gene Symbol: CATSPER2
  Gene Name: cation channel, sperm associated 2
  ENST ID: ENST00000409481
  CDS Start-End: 376-568
gtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagcagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctag

SEQ ID NO: 115054 - DNA, 457 bp, Homo sapiens
  Payload ID: 2465
  Gene Symbol: CATSPER2
  Gene Name: cation channel, sperm associated 2
  ENST ID: ENST00000450810
  CDS Start-End: 1-224
ccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcaggaaaaaaaaaggccgggcacggtggctcacacctgtaatcccagcactttgggaggccgaggcgggcagatcacaaggtcaggagattaggatcatcctggccaacatgtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtg

SEQ ID NO: 115055 - DNA, 1468 bp, Homo sapiens
  Payload ID: 2465
  Gene Symbol: CATSPER2
  Gene Name: cation channel, sperm associated 2
  Uniprot ID: Q96P56
  ENST ID: ENST00000433380
  CDS Start-End: 1-1245
atggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacaggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatag

SEQ ID NO: 115056 - DNA, 252 bp, Homo sapiens
  Payload ID: 2465
  Gene Symbol: CATSPER2
  Gene Name: cation channel, sperm associated 2
  ENST ID: ENST00000432420
  CDS Start-End: 14-252
ggctgtggcagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgc

SEQ ID NO: 115057 - DNA, 462 bp, Homo sapiens
  Payload ID: 2465
  Gene Symbol: CATSPER2
  Gene Name: cation channel, sperm associated 2
  ENST ID: ENST00000419262
  CDS Start-End: 1-40
actgacgtcaagccatagcaaaatagaggacagatcctaagttaaggatcttgagatgagatcatcctagattatccagttcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcag

SEQ ID NO: 115058 - DNA, 1367 bp, Homo sapiens
  Payload ID: 2466
  Gene Symbol: CATSPER3
  Gene Name: cation channel, sperm associated 3
  Uniprot ID: Q86XQ3
  ENST ID: ENST00000282611
  CDS Start-End: 87-1283
cagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatttaagaggaacgatgatgaatgtcgggcatttgtgaagagagtcataatgagccgtttctttaagataattatgattagcactgtcacatcgaatgcgttttttatggccttgtggaccagttatgacataaggtaccgcttgttcagacttcttgagttctcggagatcttctttgtgtccatctgcacatctgagttgtccatgaaggtctatgtggaccccatcaactactggaagaacggctacaacctgctggatgtgatcattatcatcgttatgtttttaccctatgccctccgccagctcatgggcaaacagttcacttacctgtatatcgctgatggcatgcagtccctgcgcatcctcaagcttatcggctatagccagggcatccggacgctgatcaccgccgtggggcagacagtctacaccgtggcctctgtgctcctcctgctcttcctcctcatgtacatcttcgctatcttgggcttctgcctgtttggatctccagacaatggtgaccatgataactgggggaacctggctgcagcttttttcaccctcttcagcttggccacggttgatggctggacagacctgcagaagcagttggacaatcgggaatttgctttgagccgggcattcaccatcatcttcatcttgctcgcctctttcatcttcctcaacatgttcgtgggtgtgatgatcatgcacacagaggactccatcagaaagtttgagcgagagctgatgttggagcagcaggagatgctcatgggagagaagcaggtgattctgcagcggcagcaggaggagatcagcaggctgatgcacatacagaaaaatgctgactgcacaagtttcagtgagctggtggagaactttaagaagaccttgagccacactgacccaatggtcttggatgattttggcactagcttacccttcatcgatatctacttttccactctggactaccaggacacaactgtccacaagcttcaagagctgtactatgagatcgtgcatgtgctgagcctaatgctggaagacttgccccaggagaagccccagtccttggaaaaggtggatgagaagtagctgggcatggggcacccatgtgccgagagccttgcagaccatgacaggtccctattaaacacaggctttctgagttgtcctctc

SEQ ID NO: 115059 - DNA, 1516 bp, Homo sapiens
  Payload ID: 2467
  Gene Symbol: CATSPER4
  Gene Name: cation channel, sperm associated 4
  ENST ID: ENST00000338855
  CDS Start-End: 68-1516
accacgagggggagtgagaccacttggagtgaagattctttgaggagaaggaagagactgagcaaacatgagggataatgaaaaggcctggtggcagcaatggacctcccatacaggcctcgaggggtggggcgggactcaggaggaccgtatggggtttggaggggcagtagctgcactgaggggccgcccctctcccctgcagagtaccattcacgagtcctacggtcggccagaggagcaagtgctcatcaaccgccaggaaatcacgaacaaagcggacgcctgggacatgcaggagttcatcactcacatgtacatcaagcagctgctccgacaccccgccttccaactgctgctggccctgctgctggtgatcaatgccatcaccatcgctctccgtaccaactcctacctggaccagaaacactatgagttgttctctaccatagatgacattgtgctgaccatccttctttgtgaggttctccttggctggctcaatggcttctggattttctggaaggacggctggaacatcctcaacttcattatcgtctttatcttgctcttgcggttcttcattaatgaaatcaatattccctccatcaactacactctcagggcgcttcgtctggtgcatgtgtgcatggcggtggagcccctcgcccggatcatccgcgtcatcctgcagtcggtgcctgacatggccaatatcatggtcctcatcctcttcttcatgctggttttttccgtgtttggagtaacactctttggtgcattcgtgcccaagcatttccagaacatacaggttgcgctgtacaccctcttcatctgcatcacccaggacggctgggtggacatctacagtgacttccagacagagaagagggaatatgcaatggagattgggggtgccatctactttaccatcttcatcaccatcggtgccttcattggcatcaacctgttcgtcatcgtggtgaccaccaacctggagcaaatgatgaaggcaggagagcagggacaacagcaacgaataacctttagtgagacaggcgcagaggaagaggaggagaatgaccagctgccactggtgcattgtgtggtcgcccgctcggagaaatctggtctcctccaggaaccccttgcgggaggccccctgtcgaacctctcagaaaacacgtgtgacaacttttgcttggtgcttgaggcaatacaggagaacctgaggcagtacaaggagatccgagatgaactcaacatgattgtggaggaggtgcgcgcaatccgcttcaaccaggagcaggagtcagaggtgttgaacaggcgctcgtcgacgagcgggtcgttggagactacgtcatccaaggacatccgccagatgtctcaacagcaagacttgctcagtgcgctcgttagcatggaaaaggtgtgccttccttctcctacccaatgggtactcgccctgacactctgctcagcccagcccagccgggcctctggaccatttgtc

SEQ ID NO: 115060 - DNA, 1912 bp, Homo sapiens
  Payload ID: 2467
  Gene Symbol: CATSPER4
  Gene Name: cation channel, sperm associated 4
  Uniprot ID: Q7RTX7
  ENST ID: ENST00000456354
  CDS Start-End: 68-1486
accacgagggggagtgagaccacttggagtgaagattctttgaggagaaggaagagactgagcaaacatgagggataatgaaaaggcctggtggcagcaatggacctcccatacaggcctcgaggggtggggcgggactcaggaggaccgtatggggtttggaggggcagtagctgcactgaggggccgcccctctcccctgcagagtaccattcacgagtcctacggtcggccagaggagcaagtgctcatcaaccgccaggaaatcacgaacaaagcggacgcctgggacatgcaggagttcatcactcacatgtacatcaagcagctgctccgacaccccgccttccaactgctgctggccctgctgctggtgatcaatgccatcaccatcgctctccgtaccaactcctacctggaccagaaacactatgagttgttctctaccatagatgacattgtgctgaccatccttctttgtgaggttctccttggctggctcaatggcttctggattttctggaaggacggctggaacatcctcaacttcattatcgtctttatcttgctcttgcggttcttcattaatgaaatcaatattccctccatcaactacactctcagggcgcttcgtctggtgcatgtgtgcatggcggtggagcccctcgcccggatcatccgcgtcatcctgcagtcggtgcctgacatggccaatatcatggtcctcatcctcttcttcatgctggttttttccgtgtttggagtaacactctttggtgcattcgtgcccaagcatttccagaacatacaggttgcgctgtacaccctcttcatctgcatcacccaggacggctgggtggacatctacagtgacttccagacagagaagagggaatatgcaatggagattgggggtgccatctactttaccatcttcatcaccatcggtgccttcattggcatcaacctgttcgtcatcgtggtgaccaccaacctggagcaaatgatgaaggcaggagagcagggacaacagcaacgaataacctttagtgagacaggcgcagaggaagaggaggagaatgaccagctgccactggtgcattgtgtggtcgcccgctcggagaaatctggtctcctccaggaaccccttgcgggaggccccctgtcgaacctctcagaaaacacgtgtgacaacttttgcttggtgcttgaggcaatacaggagaacctgaggcagtacaaggagatccgagatgaactcaacatgattgtggaggaggtgcgcgcaatccgcttcaaccaggagcaggagtcagaggtgttgaacaggcgctcgtcgacgagcgggtcgttggagactacgtcatccaaggacatccgccagatgtctcaacagcaagacttgctcagtgcgctcgttagcatggaaaaggttcatgactctagctcacaaatactccttaaaaaacacaagagcagccactgagaggccaggatgggagccaaggggcctgcacacacacacccagccgctgcgtcttcctgtgtccttagtgtggcttggcagagcctggccagagcccatcctctcccttatacctgggcagaggccaggggctgtgaaggtggcagcacctgcaggtctggtgcctgtgagccccaggtccggtggagcaaggagagaggaggatgctggatgatgagagtgggaaccctagcagcaaggatgagcacagaagggggtgctggccaacgcagccaggatttgacctaaggatggggatccctggccccctgctcttgcccagagctggtggggggcctcagtgggccccagaaccaagaagagaaaggcaaggccagtggggccagacatctgtgtgttgacaataaagttttgtgttggaatcaa

SEQ ID NO: 115061 - DNA, 1831 bp, Homo sapiens
  Payload ID: 2467
  Gene Symbol: CATSPER4
  Gene Name: cation channel, sperm associated 4
  Uniprot ID: Q7RTX7
  ENST ID: ENST00000518899
  CDS Start-End: 1-1155
atgagggataatgaaaaggcctggtggcagcaatggacctcccatacaggcctcgaggggtggggcgggactcaggaggaccgtatggggtttggaggggcagtagctgcactgaggggccgcccctctcccctgcagagtaccattcacgagtcctacggtcggccagaggagcaagtgctcatcaaccgccaggaaatcacgaacaaagcggacgcctgggacatgcaggagttcatcactcacatgtacatcaagcagctgctccgacaccccgccttccaactgctgctggccctgctgctggtgatcaatgccatcaccatcgctctccgtaccaactcctacctggaccagaaacactatgagttgttctctaccatagatgacattgtgctgaccatccttctttgtgaggttctccttggctggctcaatggcttctggattttctggaaggacggctggaacatcctcaacttcattatcgtctttatcttgctcttgcggttcttcattaatgaaatcaatattccctccatcaactacactctcagggcgcttcgtctggtgcatgtgtgcatggcggtggagcccctcgcccggatcatccgcgtcatcctgcagtcggtgcctgacatggccaatatcatggtcctcatcctcttcttcatgctgcatttccagaacatacaggttgcgctgtacaccctcttcatctgcatcacccaggacggctgggtggacatctacagtgacttccagacagagaagagggaatatgcaatggagattgggggtgccatctactttaccatcttcatcaccatcggtgccttcattggcatcaacctgttcgtcatcgtggtgaccaccaacctggagcaaatgatgaaggcaggagagcagggacaacagcaacgaataacctttagtgagacaggcgcagaggaagaggaggagaatgaccagctgccactggtgcattgtgtggtcgcccgctcggagaaatctggtctcctccaggaaccccttgcgggaggccccctgtcgaacctctcagaaaacacgtgtgacaacttttgcttggtgcttgaggcaatacaggagaacctgaggcagtacaaggagatccgagatgaactcaacatgtaggggagggtactggggctgcccccaagtcatgattgtggaggaggtgcgcgcaatccgcttcaaccaggagcaggagtcagaggtgttgaacaggcgctcgtcgacgagcgggtcgttggagactacgtcatccaaggacatccgccagatgtctcaacagcaagacttgctcagtgcgctcgttagcatggaaaaggttcatgactctagctcacaaatactccttaaaaaacacaagagcagccactgagaggccaggatgggagccaaggggcctgcacacacacacccagccgctgcgtcttcctgtgtccttagtgtggcttggcagagcctggccagagcccatcctctcccttatacctgggcagaggccaggggctgtgaaggtggcagcacctgcaggtctggtgcctgtgagccccaggtccggtggagcaaggagagaggaggatgctggatgatgagagtgggaaccctagcagcaaggatgagcacagaagggggtgctggccaacgcagccaggatttgacctaaggatggggatccctggccccctgctcttgcccagagctggtggggggcctcagtgggccccagaaccaagaagagaaaggcaaggccagtggggccagacatctgtgtgttgacaataaagttttgtgttggaatcaa

SEQ ID NO: 115062 - DNA, 1404 bp, Homo sapiens
  Payload ID: 2467
  Gene Symbol: CATSPER4
  Gene Name: cation channel, sperm associated 4
  ENST ID: ENST00000611853
  CDS Start-End: 33-1154
atgagggataatgaaaaggcctggtggcagcaatggacctcccatacaggcctcgaggggtgggcgggactcaggaggaccgtatggggtttggaggggcagtagctgcactgaggggccgcccctctcccctgcagagtaccattcacgagtcctacggtcggccagaggagcaagtgctcatcaaccgccaggaaatcacgaacaaagcggacgcctgggacatgcaggagttcatcactcacatgtacatcaagcagctgctccgacaccccgccttccaactgctgctggccctgctgctggtgatcaatgccatcaccatcgctctccgtaccaactcctacctggaccagaaacactatgagttgttctctaccatagatgacattgtgctgaccatccttctttgtgaggttctccttggctggctcaatggcttctggattttctggaaggacggctggaacatcctcaacttcattatcgtctttatcttgctcttgcggttcttcattaatgaaatcaatattccctccatcaactacactctcagggcgcttcgtctggtgcatgtgtgcatggcggtggagcccctcgcccggatcatccgcgtcatcctgcagtcggtgcctgacatggccaatatcatggtcctcatcctcttcttcatgctgcatttccagaacatacaggttgcgctgtacaccctcttcatctgcatcacccaggacggctgggtggacatctacagtgacttccagacagagaagagggaatatgcaatggagattgggggtgccatctactttaccatcttcatcaccatcggtgccttcattggcatcaacctgttcgtcatcgtggtgaccaccaacctggagcaaatgatgaaggcaggagagcagggacaacagcaacgaataacctttagtgagacaggcgcagaggaagaggaggagaatgaccagctgccactggtgcattgtgtggtcgcccgctcggagaaatctggtctcctccaggaaccccttgcgggaggccccctgtcgaacctctcagaaaacacgtgtgacaacttttgcttggtgcttgaggcaatacaggagaacctgaggcagtacaaggagatccgagatgaactcaacatgtaggggagggtactggggctgcccccaagtcatgattgtggaggaggtgcgcgcaatccgcttcaaccaggagcaggagtcagaggtgttgaacaggcgctcgtcgacgagcgggtcgttggagactacgtcatccaaggacatccgccagatgtctcaacagcaagacttgctcagtgcgctcgttagcatggaaaaggttcatgactctagctcacaaatactccttaaaaaacacaagagcagccactga

SEQ ID NO: 115063 - DNA, 3623 bp, Homo sapiens
  Payload ID: 2468
  Gene Symbol: CATSPERB
  Gene Name: catsper channel auxiliary subunit beta
  Uniprot ID: Q9H7T0
  ENST ID: ENST00000256343
  CDS Start-End: 158-3508
gctgattggctgttaccaaaggtgactagagtgctaagccagtcaacagggaaaacttggctcctgactttgggtctttcttctcagtctatatggaagaaaactgagaaaaaatataaaaaagaagaacacaactagttgcgcatctcctaaagagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaatttaacgttgttcagtgatcggattttgtggttggttgatattcctagagaaaacatcacacaaagcacagatattgcagctgtagaagaatggttagtaagaatcactttacatcatggactaaatatttatgctactgaaggaactctattggatgttattcgagaaccgattcttcagtggactcctggggatgtgattccagaaagtgaaatcagtaaattatatccacatgtggtagatctcaaagtgacaaaatgcccctgtgccaatgatgtggcattactaggcttcattgtggatacaatagttgatggtgtttacataggcataacctttggtggattctggcatgattatgataccacatggtttaacatgacacagactatctattcccaacttcaagaagaatatgaagacctttcattggtggatatggttttaacgaatcattttttagttatcctcacctctttgggcctttttgtaagtgaagatcttcgttatccatcacgccacagcttatcgttttccagggcagacttttgtggttttgaaagggttgactatgtgaaaggaaaactgtggtataatgaaagatgttttgctaacagagagcactttgaagttgattatgttacagttacctttgagagaaacagaaccctaagtgagtcaagctcttgtttttatagtcaggaaccatttcttgaatgggtaccctgcttacctcacatttttaaaggaataaaaatttttccaactgtgctaacatttcttgttgaccaagagcgtggtactggagtttacctcttctataacaaggtcaggaaaactgccattgcctctgtgagcaccctgagaaataatgaaccaaattcacaatcaaaatttccaatttttcggtttccttcatcattctcttctcccgttggaatggtatttcatccccgaagccactttttgtatgcttatggcaatcagatatggctttcagttgatggcggcaacacctttcaattaatagctaactttcatgatgatatcataaagaagacttttcatagtttttatacatcagctattacttttgtttctcaacgtggaaaggtttactcgacaaaggcaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacatcgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtgacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtgaacacatggtgatcataatttctctttattttctagttttatcagccaattcctagaacaatatatttaaatgttaaatatgcaagctacataaaatcctaaagaattgtcattat

SEQ ID NO: 115064 - DNA, 582 bp, Homo sapiens
  Payload ID: 2468
  Gene Symbol: CATSPERB
  Gene Name: catsper channel auxiliary subunit beta
  ENST ID: ENST00000553329
  CDS Start-End: 131-582
agagtgctaagccagtcaacagggaaaacttggctcctgactttgggtctttcttctcagtctatatggaagaaaactgagaaaaaatataaaaaagaagaacacaactagttgcgcatctcctaaagagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgttcagtgatcggattttgtggttggttgatattcctagagaaaacatcacacaaagcacagatattgcagctgtagaagaatggttagtaagaatcactttacatcatggactaaatatttatgctactgaaggaactctattggatgttattcgagaaccgattcttcagtggactcctggggatgtgattccagaaagtgaaatcagtaaattatatccacatgtggtagatctcaaagtgacaaaatgcccctgtgccaatgatgtggcattactaggctt

SEQ ID NO: 115065 - DNA, 430 bp, Homo sapiens
  Payload ID: 2468
  Gene Symbol: CATSPERB
  Gene Name: catsper channel auxiliary subunit beta
  ENST ID: ENST00000553676
  CDS Start-End: 210-430
acgcaaggagaaggaaatcataatgatgtcatgtgatcaaaggaaaccatggaagggttcacgctgatagctgatagcttttacagtgctcattcctaacagtggatttactttagagacaggattttgccatgtttgccaggttggccttgaactcctgacctcaggtgatccacctgcctcgacctcccaaagtgcttggattacagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgct

SEQ ID NO: 115066 - DNA, 2229 bp, Homo sapiens
  Payload ID: 2468
  Gene Symbol: CATSPERB
  Gene Name: catsper channel auxiliary subunit beta
  ENST ID: ENST00000557036
  CDS Start-End: 1-204
aatgaaccaaattcacaatcaaaatttccaatttttcggtttccttcatcattctcttctcccgttggaatggtatttcatccccgaagccactttttgtatgcttatggcaatcaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacatcgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtgacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtgaacacatggtgatcataatttctctttattttctagttttatcagccaattcctagaacaatatatttaaatgttaaatatgcaagctacataaaatcctaaagaattgtcattataattcaaattgctacttgtcaatatattcaccatttccttttcttattttgaatacatagaaaatgtcttatgccagg

SEQ ID NO: 115067 - DNA, 491 bp, Homo sapiens
  Payload ID: 2468
  Gene Symbol: CATSPERB
  Gene Name: catsper channel auxiliary subunit beta
  ENST ID: ENST00000556661
  CDS Start-End: 270-491
acgcaaggagaaggaaatcataatgatgtcatgtgatcaaaggaaaccatggaagggttcacgctgatagctgatagcttttacagtgctcattcctaacagtggatttacttgcagaactccgttagagaagatttaatccggattccaccgctgctccactgctgctgtcctctgttcttttccacacaacctctacctgacttcactttggtgtggactctggagttgatccctctggtttcatatgcttcttttcctacttatatatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgcta

SEQ ID NO: 115068 - DNA, 432 bp, Homo sapiens
  Payload ID: 2468
  Gene Symbol: CATSPERB
  Gene Name: catsper channel auxiliary subunit beta
  ENST ID: ENST00000554560
  CDS Start-End: 133-432
tcttgacctttacccacttacgcaaggagaaggaaatcataatgatgtcatgtgatcaaaggaaaccatggaagggttcacgctgatagctgatagcttttacagtgctcattcctaacagtggatttacttatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaat

SEQ ID NO: 115069 - DNA, 3623 bp, Homo sapiens
  Payload ID: 2468
  Gene Symbol: CATSPERB
  Gene Name: catsper channel auxiliary subunit beta
  Uniprot ID: Q9H7T0
  ENST ID: ENST00000619027
  CDS Start-End: 158-3508
gctgattggctgttaccaaaggtgactagagtgctaagccagtcaacagggaaaacttggctcctgactttgggtctttcttctcagtctatatggaagaaaactgagaaaaaatataaaaaagaagaacacaactagttgcgcatctcctaaagagatggaatcgccacttatatatgtttcagttttgcttttgaacatatttgaattttcatcaggaatagtatataataaagatgatacagagaaacgctttgcatgttctaacaaagggttccctcaagagaatgaaataatcaagttgtatcttttcttagaaaacttgaaaatccagtgtttcttccaaactgaaaatgaaattgcatcaaaagcaatgctaagtgtgttcacatcaggaggacttgctcccagcttgggaatcatgaatagtacatataatggcatcttccactttaatttaacgttgttcagtgatcggattttgtggttggttgatattcctagagaaaacatcacacaaagcacagatattgcagctgtagaagaatggttagtaagaatcactttacatcatggactaaatatttatgctactgaaggaactctattggatgttattcgagaaccgattcttcagtggactcctggggatgtgattccagaaagtgaaatcagtaaattatatccacatgtggtagatctcaaagtgacaaaatgcccctgtgccaatgatgtggcattactaggcttcattgtggatacaatagttgatggtgtttacataggcataacctttggtggattctggcatgattatgataccacatggtttaacatgacacagactatctattcccaacttcaagaagaatatgaagacctttcattggtggatatggttttaacgaatcattttttagttatcctcacctctttgggcctttttgtaagtgaagatcttcgttatccatcacgccacagcttatcgttttccagggcagacttttgtggttttgaaagggttgactatgtgaaaggaaaactgtggtataatgaaagatgttttgctaacagagagcactttgaagttgattatgttacagttacctttgagagaaacagaaccctaagtgagtcaagctcttgtttttatagtcaggaaccatttcttgaatgggtaccctgcttacctcacatttttaaaggaataaaaatttttccaactgtgctaacatttcttgttgaccaagagcgtggtactggagtttacctcttctataacaaggtcaggaaaactgccattgcctctgtgagcaccctgagaaataatgaaccaaattcacaatcaaaatttccaatttttcggtttccttcatcattctcttctcccgttggaatggtatttcatccccgaagccactttttgtatgcttatggcaatcagatatggctttcagttgatggcggcaacacctttcaattaatagctaactttcatgatgatatcataaagaagacttttcatagtttttatacatcagctattacttttgtttctcaacgtggaaaggtttactcgacaaaggcaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacattgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtcacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtgaacacatggtgatcataatttctctttattttctagttttatcagccaattcctagaacaatatatttaaatgttaaatatgcaagctacataaaatcctaaagaattgtcattat

SEQ ID NO: 115070 - DNA, 430 bp, Homo sapiens; identical to SEQ ID NO: 115065
  Payload ID: 2468
  Gene Symbol: CATSPERB
  Gene Name: catsper channel auxiliary subunit beta
  ENST ID: ENST00000631383
  CDS Start-End: 210-430

SEQ ID NO: 115071 - DNA, 2229 bp, Homo sapiens
  Payload ID: 2468
  Gene Symbol: CATSPERB
  Gene Name: catsper channel auxiliary subunit beta
  ENST ID: ENST00000633011
  CDS Start-End: 1-204
aatgaaccaaattcacaatcaaaatttccaatttttcggtttccttcatcattctcttctcccgttggaatggtatttcatccccgaagccactttttgtatgcttatggcaatcaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacattgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtcacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtgaacacatggtgatcataatttctctttattttctagttttatcagccaattcctagaacaatatatttaaatgttaaatatgcaagctacataaaatcctaaagaattgtcattataattcaaattgctacttgtcaatatattcaccatttccttttcttattttgaatacatagaaaatgtcttatgccagg

SEQ ID NO: 115072 - DNA, 582 bp, Homo sapiens; identical to SEQ ID NO: 115064
  Payload ID: 2468
  Gene Symbol: CATSPERB
  Gene Name: catsper channel auxiliary subunit beta
  ENST ID: ENST00000631902
  CDS Start-End: 131-582

SEQ ID NO: 115073 - DNA, 491 bp, Homo sapiens; identical to SEQ ID NO: 115067
  Payload ID: 2468
  Gene Symbol: CATSPERB
  Gene Name: catsper channel auxiliary subunit beta
  ENST ID: ENST00000632189
  CDS Start-End: 270-491

SEQ ID NO: 115074 - DNA, 432 bp, Homo sapiens; identical to SEQ ID NO: 115068
  Payload ID: 2468
  Gene Symbol: CATSPERB
  Gene Name: catsper channel auxiliary subunit beta
  ENST ID: ENST00000631777
  CDS Start-End: 133-432

SEQ ID NO: 115075 - DNA, 2516 bp, Homo sapiens
  Payload ID: 2469
  Gene Symbol: CATSPERD
  Gene Name: catsper channel auxiliary subunit delta
  Uniprot ID: Q86XM0
  ENST ID: ENST00000381624
  CDS Start-End: 62-2458
gattgtgcagcgactccccgtggcggttgaggggcagtggtggcggcggaagcccaagtcgatgctgatgttgatgctggtggcggctgtgaccatgtggctccgaccgctggtcacagctcagctctgtcgttctcgcacagtgaggacaggaaaagtgtttaatctgatacaggacgttcaaggggaccgcctgtattttcatcctacaacaacacgcttgattaaacatccttgcgagaaaaatatagcactatatctagggaaacaagtttttttcacaatggataactttgagactagtctccttccatttaccatccctacatcaatgcaggtcggcgtaccagaagtgacatcagcacattttgctggttcgttattgctgttagtagtggatcaaaaagtctatatttatgattatgaaaataattcttggagcatgtctttaggtataaaacaccctgttacacatgtctctggtgataattgttgttatactggaagtttgttttgtgtgcatgtcagtaatttggtttttgcatatttccgtggagatcagatatcccagacttatatatattattcaaatactgggggattcagtttttggaagtatcactatgacagacaggcagaaatcattgggtctttaggcggaatcttccactttttttctttgtcacaggttgcgatgcttgtagtgaatcaagggaagggcatgttcaagtactcagatcaccccctcaaccggagtttcgggctgtcttttgactataatgggactctagacatcctcatcgcccccggccagagaggcatcctgctcctatggtttgagaacagcctgttgttttcccataatgcaggtcagctcgtcgacaccgtccgggtgaaaaaaggagaccagaccttgttttcttccatttttgaagccaagatcaccatccacaacattgctgtcactgaaaatgaactggcagttataactcgggaggataatttgtattatggcaatctgggcatcgtgccaagttccataatcaaatttgcagaccaatacatctggtcagaagacgtggccctgatgttcaggagcccagggactctggaaatactgaccccactgcgtgacacagcctttccagcttttgatttccagaagtgcctcgtgaatatccaggcgcttctcatggaccctgaactccacgttggaaagtgcaagatagagtttctgacaggagaatttatatacaggatgtataccattgacatgcacagccagctggaattgactgcttcgttgataccccagccaggcacatccctgattcctctggtgatggtgagcaacccccactccctggggttccaggccaccttctacgagaacggttacacatcagatgggaacaccaagtacaaactggatattttcctaaaacagcagcagcactggggcaggaccgactccaacttcacttccagtttaaagaaagccaccatgtctaccttaactgtggacatagcaaacaaggaaatttcatgtgtggatatcaagccactgtcgacactgatttcagttggctgcgacctggataaaaagatcgtcatccagaacaaagtttccgcctgttccatgggcatcctggaccccttgaccctgcaagacaattacagcttcatcatcgagaaggaattctacgaccccggcttccaggggcagcagtcctccgaggacctgcacgtgttttactcctaccagcagctgggctgtcctctcctcgtctactatgacaccctatggaagcccgtggtggagctgtggcgaaaagacagtttccaggaggtcatcgacgccgagtatgtgttactggaggtgaacgggcagttctcatactcctattccctgacggcccagtcggccatgtgtacctcccagccgcagaactggaccaccatgataaaggaattcggggggcccttcttctggaacagagagaactatgtgagctgccacgaccccaacaacaatgcccctttgaggtggccagacgtccagtatcagatcttgggcggccggacagcaaaccagatcattttcggccacaatggcttttatgtcttctacatttcgatcgtggatccgtactacagctactgtcaactggagaccatctttagcatctacgtgtatggagcattccccgtgcagctggtctctgctggagtcgtcatcctactgatcatctccagcatcctggggtccgtttggctggcctacaagacccccaagctgctacgcacagcacgcggccgcaggatcaagaagtgtgcgacacagctgtgtaggagatgcaagacggtctgccagttcagggcctcagccacagccagggcaggcacagagcccccgggacgccaccgcactcctcacggaggcaggtctgaccactgaggccggtccacagggtcccaaccccttgtcttcaaataaagtataatgtaacatagca

SEQ ID NO: 115076 - DNA, 3501 bp, Homo sapiens
  Payload ID: 2470
  Gene Symbol: CATSPERG
  Gene Name: catsper channel auxiliary subunit gamma
  ENST ID: ENST00000312265
  CDS Start-End: 73-951
aagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagga

SEQ ID NO: 115077 - DNA, 2634 bp, Homo sapiens
  Payload ID: 2470
  Gene Symbol: CATSPERG
  Gene Name: catsper channel auxiliary subunit gamma
  ENST ID: ENST00000409410
  CDS Start-End: 653-2634
ggaagagtcgtgggagctgggagaggagggaaagaggggaagagtcgtgggagctggcagaggagggaaagggggagccgaacgtgaagggcgaagggcggggcggggcaggagagtcggggtatagagcaggcaggtgttaatggcatgggaaggaagagtaagaagtggggcaagaaggtgtcgcggtacgaggggaaggtgagactcaagaaggtgccggctaagaagctggtgccggcgtggaaggagaaggtgtggggcgaggaaacaacgaagggcgaggaaagatcccgaggcgaagagacagttttcatcgagaaggggcagggcgaggaggaggggcgttaccagagggcgggacggggcgacgggcccgcgcgggaagaaccaatcgccgagaacccggggaaggaacgggtccataaagaccaagtggaggagtaggggcgcggtcaggagcggaagcagagtgaggagcaagccccgggcgagaaacgggggcccggccgggagcaagagcaggggcggggccgggagcaagagcaggggcggggcccggagacgggcgagaccaggtacagtacccagcccctgggcagaccccgagcgaggagaaagcggcgataccaagagaagttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccg

SEQ ID NO: 115078 - DNA, 3746 bp, Homo sapiens
  Payload ID: 2470
  Gene Symbol: CATSPERG
  Gene Name: catsper channel auxiliary subunit gamma
  Uniprot ID: Q6ZRH7
  ENST ID: ENST00000409235
  CDS Start-End: 116-3595
gaagtcggctgtggaagtgtgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagga

SEQ ID NO: 115079 - DNA, 3626 bp, Homo sapiens
  Payload ID: 2470
  Gene Symbol: CATSPERG
  Gene Name: catsper channel auxiliary subunit gamma
  ENST ID: ENST00000410018
  CDS Start-End: 116-3475
gaagtcggctgtggaagtgtgggcggccattttgagaccgggcaagaggggcgggactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggagctgagcattgacagttgctgggtgggctccttctactgcccccattctggcttcacagccaccatctatgacactattgccaccgagagcaccctcttcattcggcagaaccagctggtctactattttacaggcacctataccacactctatgagagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagga

SEQ ID NO: 115080 - DNA, 2899 bp, Homo sapiens
  Payload ID: 2470
  Gene Symbol: CATSPERG
  Gene Name: catsper channel auxiliary subunit gamma
  ENST ID: ENST00000412458
  CDS Start-End: 1-498
cgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgaagacggggtttcaccatattggtcagtctggtcttgaactcctgacctcaagtgatccacctgcctcggcctcccaaagtgctggtattataggtgtgaaccactatgcctggcctaacctgcatttattggataatgaataaagaagggaataaatgaaagatgtgactttgtacctagtggctctgtctggagaatgccccatgctatgacaatgttccccaaggcatctttgcccctgaattcttcttcaaggtgttggtgagcaatagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatc

SEQ ID NO: 115081 - DNA, 668 bp, Homo sapiens
  Payload ID: 2470
  Gene Symbol: CATSPERG
  Gene Name: catsper channel auxiliary subunit gamma
  ENST ID: ENST00000475343
  CDS Start-End: 42-452
agttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagtccccagtcaacttctaccgctggaagatagagcagctgcagatccagatggaggctgcccccttccgcagcaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtgg

SEQ ID NO: 115082 - DNA, 3785 bp, Homo sapiens
  Payload ID: 2470
  Gene Symbol: CATSPERG
  Gene Name: catsper channel auxiliary subunit gamma
  ENST ID: ENST00000471517
  CDS Start-End: 58-537
ggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacagcttctttgagcaagagcccgtggacacagtgagcagcttgtttcacatgctggtggactcacccatcgacccgagcgagaaatacctgggcttcccttactacctgaagatcaactactcctgcgaggaaaagacggagtcttgcgctgttgcccagactggagtgcagtggcgcgatctcggctcactgcaacctccgcctcccgtgttcaagcgatgctcctgcctcggcctcccaagtagctggaactacagccctctgaggacctggtgcgcatgggccacctgacggggctaaagcccctggtgctggtcaccttccagtccccagtcaacttctaccgctggaagatagagcagctgcagatccagatggaggctgcccccttccgcagcaaagagccatgcatggcagaagaagtgtgtagcatgagctggtacacgcccatgcccatcaagaaaggcagtgtggtcatgcgtgtggacatcagcagcaatggcctggggaccttcattccagataaaaggttccagatgaatatcaacggcttcctgaagagagaccgggacaataacatccaattcactgtgggagaggagctcttcaacctgatgccccagtactttgtgggtgtctcatcgaggcccttgtggcacactgtggaccagtcacctgtgcttatcctgggaggcattcccaatgagaagtacgtcctgatgactgacaccagcttcaaggacttctctctcgtggaggcagttggattcgtgtcctggccagcgagtgcatcaagaagctgtgccctgtgtatttccatagcaatggctctgagtacataatggccctcaccacgggcaagcatgagggttatgtacacttcgggaccatcagagatggccaggtgtcctttgagatgctgcccaggcagtggtctgtgtgcgagcagataggagttaccacctgctccataatttggtctgaatacatcgcgggtgagtatactctactgctgctggtggagagtggatatggtaatgcaagtaaacgtttccaggtggtcagctacaacacagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaacagtcctctctctacgcatccaatgagaccatgctgaccctcttctacgaagacagcaaactgtaccagctggtgtaccttatgaacaaccagaagggccagctggtcaagaggctcgtgcccgtggagcagcttctgatgtatcaacagcacaccagccactatgacttggagcggaaagggggctacttgatgctctccttcatcgacttctgccccttctcggtgatgcgcctgcggagcctgcccagtccgcagagatacacgcgccaggagcgctaccgggcgcggccgccgcgcgtcctggagcgctcgggcttccacaacgagaactcgctcgccatctaccagggcctggtctactacctgctgtggctgcactccgtgtacgacaagccgtacgcggacccggtgcacgaccccacctggcgctggtgggcgaacaacaaacaagaccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgttccggacgcagtcagaactcggtctgcgcgggaccagagtggagcccgaagggcggggcgagggctaccagaatctgggagcctggggggcggggacaccatcggaggggcggggcctgtctgtgagggaggccttaaccccgtttactgcccggagcaggcaccgccttccagctgcatagccaggtggacgtgggcgtggtgctggccgaccccggctgcatcgaggcctcggtgaagcaggaggtcctgattaatcgcaactcggtgctattttcgattacgctcaaggataaaaagctttgctatgaccaaggcattagtggacatcaccttatggagacttccatgacggtcaatgtggtgggttcatccgggctctgcttccaggaaacacacctggggccccatatgcaaggcaacctgatggtgccagtgttcattggctgccccccaggcaagcgcctggccttcgacatcacctacacgctggaatacagccgcctgaagaacaaacactactttgactgcgttaacgtgaacccggagatgccctgctttctcttccgggacattttctaccccttcttcttgattcaagatttggtgacaggagactccggcagtttccagggcagctatgttctgctggtggtgggtggcgggcccacactggacagcctcaaggactacagtgaggacgaaatctaccgcttcaacagccccctggacaagaccaacagccttatctggaccacgaggaccacaaggaccaccaaagactcagcctttcacatcatgtcccacgagagcccaggcatcgagtggctctgtctggagaatgccccatgctatgacaatgttccccaaggcatctttgcccctgaattcttcttcaaggtgttggtgagcaataggtgagccagaggagtggacacgagcacctactgcaactaccagctcaccttcctgctgcacatccacgggctgccactcagtcccaagcgggcccttttcatcatcatggtgtcagctagcgtgtttgtgggcctggtgatcttctacatcgccttctgcctcctgtggcccctcgtggtgaagggctgcacgatgatccggtggaagataaacaacctcattgcctcagaatcctactacacctacgcctccatttccggaatctcgagcatgccgtctctgagacattccaggatgggctccatgttcagctccaggatgacagaggacagggctgaacccaaggaagccgtggagagacagttgatgacctgagtgtcccacctgccccagcccccagttactgtcacgcctctcttatgaggcccatcttgaagatgcaacctgtcacccagcccaggcctctctttctgttttgcttgatgtttacttctcgttcagactcaaataaagccttttttcagg

SEQ ID NO: 115083 - DNA, 541 bp, Homo sapiens
  Payload ID: 2470
  Gene Symbol: CATSPERG
  Gene Name: catsper channel auxiliary subunit gamma
  ENST ID: ENST00000489693
  CDS Start-End: 1-541
agagaaaccgcggcagtggcagttggattcgtgtcctggccagcgagtgcatcaagaagctgtgccctgtgtatttccatagcaatggctctgagtacataatggccctcaccacgggcaagcatgagggttatgtacacttcgggaccatcagagctagtgatgacctggaacttctctaccacatcccagaattcatccctgaagctcgaggattggagttcctgatgatcctagggacagagtcctacaccagcactgcaatggcccccaagggcatcttctgtaacccgtacaacaatctgatcttcatctggggcaacttcctcctgcagagctctaacaaggaaaacttcatctacctggcagacttccccaaggaactgtccatcaaatacatggccagatcgttccgtggggctgtggctattgtcacagagacggaggagatctggtacctcctggagggcagctaccgggtctaccagctgttcccttccaagggctggcaggtgcacatcagcttaaagctgatgcaaca

SEQ ID NO: 115084 - DNA, 1758 bp, Homo sapiens
  Payload ID: 2471
  Gene Symbol: CDX1
  Gene Name: caudal type homeobox 1
  Uniprot ID: P47902
  ENST ID: ENST00000231656
  CDS Start-End: 83-880
caggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccgcaagcctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacttctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaatca

SEQ ID NO: 115085 - DNA, 1343 bp, Homo sapiens
  Payload ID: 2471
  Gene Symbol: CDX1
  Gene Name: caudal type homeobox 1
  ENST ID: ENST00000616154
  CDS Start-End: 1-465
atgtgctggacaaggattcgcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccatctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacttctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaatca

SEQ ID NO: 115086 - DNA, 4053 bp, Homo sapiens
  Payload ID: 2472
  Gene Symbol: CDX2
  Gene Name: caudal type homeobox 2
  Uniprot ID: Q99626
  ENST ID: ENST00000381020
  CDS Start-End: 2134-3075
gcaatttgcttccggttgtatttctcaggaagtccgatgacactcggctgtccaggccaggcgctggaagtcccccaggaggaccagctcggtctcccacctcttgagtgcacagctccttggcccctgagtaccccaccacccccatttccagccttcttccttacaaacacgaagggtgggaggaaccagaaaacaggggatcccgcagccctaggctagttctgatcgctttcaggtgtctgcagaggcaagttgctggttgtcacctgtaaaatggggaggataaaaacacctcccagattttgttctagatcctagggggatgtgaggctcaagggagataaaggacactggagagcaccctagaaatgacaggatgaaggcgatggtgacaaatatccgagcgaaacgcttgacaatgagaacagacaagtgcaggtctccaggagtgccgcgagcgcccgcgggttctgagagcgctcaaagccgccgagtcaggctgcccagcccgccgggcctcgccgcagtgatcctcattcccgaatctggcagcgctgtcaaaggcttgtattaggaggtgaacggcggccgcaggcccactccacgcggttgctgaaaccgagctgggcgcgcgcgggggccgaatctcgccgcctccgcgctcctgtcggggcagctcccgatcccgggctgcgcggcttcggtccccaagacggccacttccagccctaggccccttggccgcagcgcttcccaaaccaagagagatcctttctcaactcagagcttttcattagcagtcgttaataatggccctgagttgccttatcatctcctggaaatgagaaataaatttcttcggagaacgtttccctttgtaaaggacagagagttttaaagatacaggtatgatgtaagacacataaatacctaggtaagcattagcagaaattctcttttccttatatttaagtataataaacatacaagtgtagctcaatgaattttcacaaactgacattctgtgtaaccagcagcctaagaaactgctttaccaacgatcccctagctcgcctccagttatgcacgccaataaccactagcctaacttctaccacatgcccattacttctgtagtttaaaacttctgattcttgaatgtaaacgtttaacaataaatcgcttgaatttaactcaaatttcaaatgtaagatgaagtcagagatgcagcctgaatctaggatcataatttgtcttgtgcggagggcgagtaatttccttgggcaagaaaataactggaggtgacagttgtttggggctgcagtcgtccgggccaggagcacagggcgggaaggaatggcccatctcttagggctctctgcttgtcacctaccaggttggtcagaaacgttctcatcaaagcaatggttctcttttcttttctctttgggacagaaggagtttcttgaccgccctcttccctgcaaatgcataaacaaccactgctcctgtctccaagctcagattcctaccaagatagccttttctcttcccctctcttttgtaagtctcttgatttcattctttgaacctgtgattggaggttaaagtgcaccaggttggaaggaggaagctcttaacaataaaggtttgaatatttagctgtgtcaggtcgctgccctctcacgagcctccctcccctttatcttttaaaatgcaaattatgtttcgaggggttgtgcgtagagtgcgcgctgcgcctcgacgtctccaaccattggtgtctgtgtcattactaatagagtcttgtaaacactcgttaatcacggaaggccgccggcctggggctccgcacgccagcctgtggcgggtcttccccgcctctgcagcctagtgggaaggaggtgggaggaaagaaggaagaaagggagggagggaggaggcaggccagagggagggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgcctggctctgtccctggggttctggggccaactgggggggtgctaaaccccaccgtcacccagtgacccaccgggttctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctgcacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaacccccaggtggcctgcgtcttttttctcttcccttcccagaccaggaaaggcttggctggtgtatgcacagggtgtggtatgagggggtggttattggactccaggcctgaccagggggcccgaacagggacttgtttagagagcctgtcaccagagcttctctgggctgaatgtatgtcagtgctataaatgccagagccaacctggacttcctgtcattttcacaatcttggggctgatgaagaagggggtggggggagtttgtgttgttgttgctgctgtttgggttgttggtctgtgtaacatccaagccagagtttttaaagccttctggatccatggggggagaagtgatatggtgaagggaagtggggagtatttgaacacagttgaattttttctaaaaagaaaaagagataaatgagctttccagatttc

SEQ ID NO: 115087 - DNA, 1515 bp, Homo sapiens
  Payload ID: 2473
  Gene Symbol: CDX4
  Gene Name: caudal type homeobox 4
  Uniprot ID: O14627
  ENST ID: ENST00000373514
  CDS Start-End: 1-855
atgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacggggaaaaccaggacaaaagaaaagtatcgtgtagtttacactgatcatcaaagattggagctggaaaaggaattccattgcaatagatatatcaccatccagagaaaatcagagctggcagttaacctgggcctttccgagagacaggtgaaaatctggtttcagaatcgcagagccaaggagagaaagatgatcaaaaagaaaatctcccagtttgagaatagtggaggctcggtgcaaagtgactctgactccatcagccctggggaactacctaacacttttttcaccacaccatctgctgttcgtggatttcaacctattgagatacagcaggttatagtctccgaatgaaagaaagcaaagagaaatttaaagtgccctttttttagtgatgtcttttgggtctctaagctatctacaggggagttggagcagggtgtaattccctgtaaggcagtatttggaacagatggatgcacaatgggttgaagataatttaggggactcttacttttagaaactatccccagaaaactcctgtcacgtgctgtgctatatgtcagtcactcaggaatcttagtggtaaggtatataattaaaagctagaatcacaggcccttccaactctgttcacaatttcagaaacttgcttatgaatagactgtaaaatacaattttgccagaaagcacatttgtgtatgtgtacttctgtttgttatttgatgctaggtgttttcttttatgctatctttaaggagtgagaagaaggtaaaccgaagtttatctatctttagctacctttccaagtgtttaattcaaaagctaacagaatttttataataagataaatgttttaaaaatcatcagaaggtgattctgattccattgtcactgcttaacaagaataaccaataaaaaagacaattttggccctcaatcatacttgtctggcatcaattatctcagaactttcaacttgcagtgtcattttaaaatcttgtcaaaacaatg

SEQ ID NO: 115088 - DNA, 2704 bp, Homo sapiens
  Payload ID: 2474
  Gene Symbol: CAV1
  Gene Name: caveolin 1, caveolae protein, 22kDa
  Uniprot ID: Q03135
  ENST ID: ENST00000341049
  CDS Start-End: 279-815
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 115089 - DNA, 2628 bp, Homo sapiens
  Payload ID: 2474
  Gene Symbol: CAV1
  Gene Name: caveolin 1, caveolae protein, 22kDa
  Uniprot ID: Q03135
  ENST ID: ENST00000393467
  CDS Start-End: 296-739
agagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 115090 - DNA, 845 bp, Homo sapiens
  Payload ID: 2474
  Gene Symbol: CAV1
  Gene Name: caveolin 1, caveolae protein, 22kDa
  Uniprot ID: Q03135
  ENST ID: ENST00000393468
  CDS Start-End: 176-619
ggcaggcgcgccctgcagagtacagaggggtgtggtgtcctctgcgagatcctcttaaaaagctggctacgcgcaggcggtttctgtgcacggagccgtagctgtcggagcgggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttcc

SEQ ID NO: 115091 - DNA, 598 bp, Homo sapiens
  Payload ID: 2474
  Gene Symbol: CAV1
  Gene Name: caveolin 1, caveolae protein, 22kDa
  ENST ID: ENST00000393470
  CDS Start-End: 63-566
agttcccttaaagcacagcccagggaaacctcctcacagttttcatccagccacgggccagcatgtctgggggcaaatacgtagactcggagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgatt

SEQ ID NO: 115092 - DNA, 2443 bp, Homo sapiens
  Payload ID: 2474
  Gene Symbol: CAV1
  Gene Name: caveolin 1, caveolae protein, 22kDa
  Uniprot ID: Q03135
  ENST ID: ENST00000405348
  CDS Start-End: 108-551
gctgcccttcagccacccgcccgcagcctgggagtgccctgaggggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaa

SEQ ID NO: 115093 - DNA, 557 bp, Homo sapiens
  Payload ID: 2474
  Gene Symbol: CAV1
  Gene Name: caveolin 1, caveolae protein, 22kDa
  ENST ID: ENST00000456473
  CDS Start-End: 144-557
agcgataaagggaacattccacgggtcgggcggctgctgttggatcttagataaagctggaagggattaccggggcagggggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaat

SEQ ID NO: 115094 - DNA, 1653 bp, Homo sapiens
  Payload ID: 2474
  Gene Symbol: CAV1
  Gene Name: caveolin 1, caveolae protein, 22kDa
  ENST ID: ENST00000451122
  CDS Start-End: 55-315
taaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaa

SEQ ID NO: 115095 - DNA, 3201 bp, Homo sapiens
  Payload ID: 2474
  Gene Symbol: CAV1
  Gene Name: caveolin 1, caveolae protein, 22kDa
  Uniprot ID: Q03135
  ENST ID: ENST00000614113
  CDS Start-End: 861-1304
taaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtc

SEQ ID NO: 115096 - DNA, 3301 bp, Homo sapiens
  Payload ID: 2475
  Gene Symbol: CAV2
  Gene Name: caveolin 2
  Uniprot ID: P51636
  ENST ID: ENST00000222693
  CDS Start-End: 393-881
ctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcgccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagccta

SEQ ID NO: 115097 - DNA, 776 bp, Homo sapiens
  Payload ID: 2475
  Gene Symbol: CAV2
  Gene Name: caveolin 2
  Uniprot ID: P51636
  ENST ID: ENST00000343213
  CDS Start-End: 43-381
accgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatat

SEQ ID NO: 115098 - DNA, 1179 bp, Homo sapiens
  Payload ID: 2475
  Gene Symbol: CAV2
  Gene Name: caveolin 2
  ENST ID: ENST00000393480
  CDS Start-End: 3-344
cgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggtgagacggggcacaccgggtggaccggctttctgaaacatgggcatattctccgccacctgccccctactctcctcttatcccaggccggcgtcaggaggaggaacgcgcatcagttcccaagcagtaggaagaactggaaggccttgaaaggcaatgcgcttcctttagaataacagtttgggcttggagtttcaacaggagaaagaatgtcggtctttcctggggtgtgattttccttgcatacataaggctgggctgagtgtggaggcgggtacctggaagccacacttcttaccacaggctgctctcggggccctgttgtgactcgtacctgcggttctgggcaggactcttctttctttcattgccttttattcagtcactgcctgtgcttggggtaaaacaaaagtgatctctgagcagaatgccgctgacagtagaattggatgaggatgtcagacctggttaagcagtagtgtggaggggctgcttcaactttgcccctggcagatggcaaggatgggacccagaggaaagggaggtgtgtgcagttaaggcgagggtcccccccagtacaaacgaatgaaaactccagctgcgggataatgaatgagaaggcctccaaattactttttcactgatgaaacacaaatggaagtggcatataattaaaggggaaagaaatatggaagcccactgtatattgataggatattttgagtaactctattcatactcaaaatgtgtcctaaactgtagagaactttcttaagcatcttttaaattttttatggaaaatgtcatattttaccaataaatgttgttgtgttagaaaa

SEQ ID NO: 115099 - DNA, 1431 bp, Homo sapiens
  Payload ID: 2476
  Gene Symbol: CAV3
  Gene Name: caveolin 3
  Uniprot ID: P56539
  ENST ID: ENST00000343849
  CDS Start-End: 78-533
ctctctgccccaagtattttcagccccagccggccacacagctcggatctcctcctgtggatccccccagctctgcgatgatggcagaagagcacacagatctcgaggcccagatcgtcaaggatatccactgcaaggagattgacctggtgaaccgagaccccaagaacattaacgaggacatagtcaaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaaagccaggtggggcaacagcggtggcagggcagggggtggtgggccagactggtccccgggggacttcttcacaggggctgctggcgagctctttctctttagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttgcgttcacttgtactgtaacaacataaaccagcacgcggttcccacccggggccaacctctccacgcgcactcaggaaagtgaccagtgaccactggcgttaggaaggtggctccagtaaagggttttggctgcatttggggaatgctgcattttgttcgtgcctgtaagattggtttgtgtcctgaccagctccaaaaatatacttcactgccctgaaaaacagacacagggagagttggttgtctcttcacttggccaaatgtaagtgaagaacagagtctttttcttcttcggattctattgtttgctggaaccgtacacgttccttggaagatcatgtttaagtgactcctgttgcctgagcacaaaaatgggcaccaatggaggaaaatgacccttgggctggcaggggcagtgacccttccagggtaccactgagggaagggcctgggttcaagcctcccggaacctcccctttggctaaccgagcccctgaaatgcccagtactgccatttgacatgagggtaccttcgccctcaggagatgtgacgaaggaacaaggtctaatttgtgcgtgtgtggactcactatggaaataaaatgcagtagaaagagcatgta

SEQ ID NO: 115100 - DNA, 1260 bp, Homo sapiens
  Payload ID: 2476
  Gene Symbol: CAV3
  Gene Name: caveolin 3
  Uniprot ID: P56539
  ENST ID: ENST00000397368
  CDS Start-End: 12-467
ccagctctgcgatgatggcagaagagcacacagatctcgaggcccagatcgtcaaggatatccactgcaaggagattgacctggtgaaccgagaccccaagaacattaacgaggacatagtcaaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaaagccagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttgcgttcacttgtactgtaacaacataaaccagcacgcggttcccacccggggccaacctctccacgcgcactcaggaaagtgaccagtgaccactggcgttaggaaggtggctccagtaaagggttttggctgcatttggggaatgctgcattttgttcgtgcctgtaagattggtttgtgtcctgaccagctccaaaaatatacttcactgccctgaaaaacagacacagggagagttggttgtctcttcacttggccaaatgtaagtgaagaacagagtctttttcttcttcggattctattgtttgctggaaccgtacacgttccttggaagatcatgtttaagtgactcctgttgcctgagcacaaaaatgggcaccaatggaggaaaatgacccttgggctggcaggggcagtgacccttccagggtaccactgagggaagggcctgggttcaagcctcccggaacctcccctttggctaaccgagcccctgaaatgcccagtactgccatttgacatgagggtaccttcgccctcaggagatgtgacgaaggaacaaggtctaatttgtgcgtgtgtggactcactatggaaataaaatgcagtagaaa

SEQ ID NO: 115101 - DNA, 6780 bp, Homo sapiens
  Payload ID: 2477
  Gene Symbol: CBLB
  Gene Name: Cbl proto-oncogene B, E3 ubiquitin protein ligase
  Uniprot ID: Q13191
  ENST ID: ENST00000264122
  CDS Start-End: 323-3271
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 115102 - DNA, 4475 bp, Homo sapiens
  Payload ID: 2477
  Gene Symbol: CBLB
  Gene Name: Cbl proto-oncogene B, E3 ubiquitin protein ligase
  ENST ID: ENST00000394030
  CDS Start-End: 1-966
ggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacatagaggagcttcccttttttgtttaagttttgtaacctttaatcctccatattctcatgtctgtcatcccaggggtgtcacaactgtaaaaatctacaatattagaaagcagctactacagatgtggaagagagaacacttgtataagacaatgctgtactgaagttatataacaaggtcccctgatacttatgcctgcattactttgagggatgctgaatgagaggaccatctccctgaaatatattaataattttcagataaaattatgaacataacataccttttctcaagtggaattagagttcatttcccatttaagtgattacactctatctcctaagagctgtgggaaccagttcatattgcagtggaaacattaactcttcgttgcactgttgagtgtcaaggctactgtggcaatgttttttgcaaagttctcagtaattttctctctgcaatcaaattagagttcatatttaatttgcagattctctcattcattgctccacactgctttatcaaatcaggtgaaagaaattaatgtagttttgcctattttacaaaatggtggttggttctttaaacaccatgttattactcttaataaatctacaaatatttattgagcatctatgatatgcttggtgctgttaggcactgtgtttttaaagcacaaactctcaaaagctgattccagcgtaatgttttatttttgtttttctgtgttttttatgacaaagtctgtctgatagacaaagcctggaaggtttcccccagggctttagaatttagaattagctggttttcatttcaaatgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttttttttattgtaaaagcgactgctcgttgatgtctggaagtgatccagactttgtttcactgtgatccaaaaagttagacattccttccatttctcaagatttggtaacaatttttttttaagtcagcatttcatataatacataaaattaagacaaattaacttactgatatgtggccaatatcaacccttctcacccaacccaaacatgttctggagatagaaggacttatcctcaattatattccagtaaatttatctccataatctgttttatcccctaatgtatgatatatctcaccaaatttttctagaattgaataaaagcagtttttgcttaacttgaatttccttccacaaatacaaccttcagctcttccctctctgtttcccttttgcccacattgcaaatagtcttcataatagaaccctcactgcaacttaaaagggtcccatttcttaactcagcatttcatataccaagaacacttgcaaagatttcttcataatgtgattttttaatttttcagttccagaagcatttcctacagttcgaacgttattttttctctcagattttcaacttgaagctttgatttgcactgaattaacttggataaaattttagtttctctcttcagctaacagatttggaagcaaattacagtatacttgaataattcaggtactacctgttgacctggaattttagtgattctgggaaagttttccagacaaagacaccaatagagtgaagggttttttccccaattactattttattgttttttaaaatgcctttttaaaacttgtgtgatgtggcaaaatagtcatatgttcaattaatttatattttattcattccttttcaattctggttattatgtaacctcaagtactttatctgttcttttaaagtattttataaaatgaacgttaactaaa

SEQ ID NO: 115103 - DNA, 1493 bp, Homo sapiens
  Payload ID: 2477
  Gene Symbol: CBLB
  Gene Name: Cbl proto-oncogene B, E3 ubiquitin protein ligase
  ENST ID: ENST00000407712
  CDS Start-End: 335-928
caggttctattgaattcttccacagagataagttaattttacatagtgtttaggatatcaacaatttttgtggcccttgtaattcttggttatagtttaaaaaaagagagactgtgttacttgagatatttacttctacattttaaaataagggatgagtatcttgatgttattactggtaattttgagaaaagaaaaatatatgttcaaactttattaaataaacaggaatactagttccctctacctctcaagttacttttaattggaaagtattctccttatataattttactctgaactgtcctttaggtcttgtgataatggtcactgtatgctgaatggaacacatggtccatcttcagagaagaaatcaaacatccctgacttaagcatatatttaaagggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgc

SEQ ID NO: 115104 - DNA, 3350 bp, Homo sapiens
  Payload ID: 2477
  Gene Symbol: CBLB
  Gene Name: Cbl proto-oncogene B, E3 ubiquitin protein ligase
  Uniprot ID: Q13191
  ENST ID: ENST00000403724
  CDS Start-End: 323-2635
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggtacgtatagaatataatttcctttgtgatgtacatcttaatggtcagaatttaaaggcaaaatttcatgccattgtactgaaaatacattaaggttttgtgttatcctctaggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaa

SEQ ID NO: 115105 - DNA, 3237 bp, Homo sapiens
  Payload ID: 2477
  Gene Symbol: CBLB
  Gene Name: Cbl proto-oncogene B, E3 ubiquitin protein ligase
  ENST ID: ENST00000405772
  CDS Start-End: 323-2755
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagcaccagttccacttacgctaattaaattatgcaaaattaaatagttgtatgtagagaactgataataaattctgttttattctaatcattacaactgtaacacattcaaaaaaa

SEQ ID NO: 115106 - DNA, 561 bp, Homo sapiens
  Payload ID: 2477
  Gene Symbol: CBLB
  Gene Name: Cbl proto-oncogene B, E3 ubiquitin protein ligase
  ENST ID: ENST00000443752
  CDS Start-End: 143-561
gctgtcctgggtagaagggtttggcagccctagggagatgaatttctccagcgttggacccgcccagagcggagaagcaacacccttccagccactactctgttgctatgaaacaaaagactaggaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacag

SEQ ID NO: 115107 - DNA, 944 bp, Homo sapiens
  Payload ID: 2477
  Gene Symbol: CBLB
  Gene Name: Cbl proto-oncogene B, E3 ubiquitin protein ligase
  ENST ID: ENST00000447441
  CDS Start-End: 526-944
aagcgaagcaggaagtcccgcctttcagccccagatggctttggctcccggtcccgacgctcacgcccacctgccaccccttattggttagctccttcgtgccttgcatcccttcgtccatttcctttcccgtttccactttcgttcccgggagagtccaggcccctcatttctctccgagtccaattcctttctgacgtgctgcgagcgggccttcctctggggccattgtgtactgtggaggacgtggacggggcggcagcgcgaggaggacgggcgcctcccgtccattggctgcacccgctgtcgggcagtgcgcggttgcgcggcattggctcagcggcgcccggccccgcccccgccccgccccgccccgagcctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacag

SEQ ID NO: 115108 - DNA, 519 bp, Homo sapiens
  Payload ID: 2477
  Gene Symbol: CBLB
  Gene Name: Cbl proto-oncogene B, E3 ubiquitin protein ligase
  ENST ID: ENST00000438603
  CDS Start-End: 35-519
aagcgaagcaggaagtcccgcctttcagccccagatggctttggctcccggtcccgacgctcacgcccacctgccaccccttattgaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacag

SEQ ID NO: 115109 - DNA, 1579 bp, Homo sapiens
  Payload ID: 2478
  Gene Symbol: CBLC
  Gene Name: Cbl proto-oncogene C, E3 ubiquitin protein ligase
  Uniprot ID: Q9ULV8
  ENST ID: ENST00000270279
  CDS Start-End: 64-1488
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtc

SEQ ID NO: 115110 - DNA, 1441 bp, Homo sapiens
  Payload ID: 2478
  Gene Symbol: CBLC
  Gene Name: Cbl proto-oncogene C, E3 ubiquitin protein ligase
  Uniprot ID: Q9ULV8
  ENST ID: ENST00000341505
  CDS Start-End: 64-1350
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcaaccacccaggctacatggccttcctcacctatgatgaggtccaagagcgtctgcaggcctgcagggacaagccaggcagctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtc

SEQ ID NO: 115111 - DNA, 11231 bp, Homo sapiens
  Payload ID: 2479
  Gene Symbol: CBL
  Gene Name: Cbl proto-oncogene, E3 ubiquitin protein ligase
  Uniprot ID: P22681
  ENST ID: ENST00000264033
  CDS Start-End: 143-2863
tccgcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcagcggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgctttccaagctgccttgttgcggggttgctgcagagcagcaactggacctttccagctgtcgccatgttccttccactaaagtagagggttcttaaaatggaaaaacctgtgggctcttcatatacctccctttagttaagtaatagaccaggcagcttctcatctcagcatttacctgttaatatttttgtgaatagtgctctctacctgtgggtggccgttctcttccacttgctcgtctccccccagccccattctgcataatctaccattcttctcctctctttctcttcttatacagaccctcattactggggcccaagatgtgggatactactgttagtattatttaactattttgtagatttaaaagatttctggttaagggaggtgggggtcactgttcatcactcttaaaatatgtgttttctctatagaaaagtaaaatgtgtttatggtcccaaacagtcaactcacaaatttttataacaaaatttccttgtaaaaactagggaccatctatatattccctttaagatctagttctttttgtaggtgttcagcaatggtgataaagcagaatattctcctacctcacgtcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctctgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcaga

SEQ ID NO: 115112 - DNA, 3457 bp, Homo sapiens
  Payload ID: 2479
  Gene Symbol: CBL
  Gene Name: Cbl proto-oncogene, E3 ubiquitin protein ligase
  ENST ID: ENST00000634586
  CDS Start-End: 121-2769
gcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcagcggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccaagcaaagcccaaaagccaacctcagatctcctgatttggcagctgaagaaatcagcagagtcctgattgcctgattcagtcccaaaaatgaatgcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagca

SEQ ID NO: 115113 - DNA, 4813 bp, Homo sapiens
  Payload ID: 2479
  Gene Symbol: CBL
  Gene Name: Cbl proto-oncogene, E3 ubiquitin protein ligase
  ENST ID: ENST00000634840
  CDS Start-End: 119-2707
ggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcagcggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggccta

SEQ ID NO: 115114 - DNA, 340 bp, Homo sapiens
  Payload ID: 2479
  Gene Symbol: CBL
  Gene Name: Cbl proto-oncogene, E3 ubiquitin protein ligase
  ENST ID: ENST00000634301
  CDS Start-End: 1-270
gccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaagttagttaactaaagagctttttcaagcacccatgtctgtaaaaaaatatttttaaataaagtttcttttgttgtagca

SEQ ID NO: 115115 - DNA, 2003 bp, Homo sapiens
  Payload ID: 2480
  Gene Symbol: CBLL1
  Gene Name: Cbl proto-oncogene-like 1, E3 ubiquitin protein ligase
  Uniprot ID: Q75N03
  ENST ID: ENST00000222597
  CDS Start-End: 23-1495
actgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcaaaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaa

SEQ ID NO: 115116 - DNA, 804 bp, Homo sapiens
  Payload ID: 2480
  Gene Symbol: CBLL1
  Gene Name: Cbl proto-oncogene-like 1, E3 ubiquitin protein ligase
  ENST ID: ENST00000415884
  CDS Start-End: 10-381
agccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacag

SEQ ID NO: 115117 - DNA, 4432 bp, Homo sapiens
  Payload ID: 2480
  Gene Symbol: CBLL1
  Gene Name: Cbl proto-oncogene-like 1, E3 ubiquitin protein ligase
  Uniprot ID: Q75N03
  ENST ID: ENST00000440859
  CDS Start-End: 468-1943
gttactccgcccgccggggtggggccagcgcaacggccgagcctgcgcagccagccggctccgggggccccgcgcactacaagtcccagaaggcagctctccgcggggcgggcagtcgccttatctgcttctggctcatttttaccactgctctccccttccccggtccccctggtgtcctttccacagttaaaggctactttctcttgaagcacatgaggagaagccttagcaacctcaataccgaagttcttcgcgcgctcgctctttctgcctccgcccgaactatgcctgagtccctcacaggagttggatagtagaggcgagagaaggaagtctttgcaggccaaaattgggacaacctgcttggacttccgcctcccggcctccggaaggcagtgcgcacgcgctcgctgcgactccggcgcggttgacttccgctcccactgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctccacctccaccaatgacctctgctccaccaccaataacccctccccctggacatattattgcccagatgccaccttatatgaatcatcctcctccaggacctcccccacctcaacatggtggtccacctgtaactgcaccccctcctcaccattataatcctaactcattaccccagttcactgaagatcaaggaactctgagccctccatttacacaaccagggggaatgagtcctggtatatggcctgcaccaagagggccaccaccacctccacgattgcagggtccgccttctcaaaccccacttcctggaccacatcatccagatcagacaagatatagaccgtattaccaatgataatagtattttgaatggaagatatgagggggaaaaaaacttatgtgtagtcaatcttttaagctttgactgttttgggaaggaagagtacctcttatcgaggtagtataaaacacatagggtcttgtttcttaaaatggttttaaatcttgaccttaagattgatttcaagtaccatactgtagtacagataagtggctcagttgagcacagctatattttaacatctctttgttcccctagtttagtaaattgacccagaggtgaccatttgtaaaaaatttgaaaaaatttttcattgttttacttcaaaagtattgttttgttaaacccaacgtttagtttttcttgtgatacattttgttaacctgtgtaaaaggattaaatttcaatatggttgtaaaaatgctatttttatgtgaatttaagtgcagccacatactgttttttaaaccatatgttttaccactaatttcccaaagttataataaaatcctgaaagtaaaaatctactagaatttgctgtaaggcagactgttaaatgatagagaattatttcacattttaggcactgaaatgttgaggtttcgaggtatagtaagtatacaatgcacttcacttggatgccttttcatttttaggcagcctcaggagcaccaaaatacattggaattctagtactaagatatatttgttcgtaatgttaaaagacattactaattatttggaaagagatggccaaaataatcaactctacaggcttcaagctggtgggggaatgctgttactcattaatgcttttttactgaatggtcggaatcacatatgcaccacacatactgatcttaagtaacattattttatagaactgtttaaatgggtttaaatggtgttctttagatgaaatgtgttctgttttgttcattgtcttaaactgaatagggctgaataggctttatgtaattcttcatttcatggtagagtttgatgctgtgtttaagtgggttcttgtttataggattttcaactacagtttgaatgccatggaggaatttgaataatatattaatgaaggacatattcttgtaatcacaaatttgcatttgctcaggtttcattgctgtgtgataggatttttcctctaacttgaaatttaaaaacttttatttcctattccttttgtcggtaaagcagtctgaatttggaacattttatcatggagtcaacagtgaagactaccagataattttgtattggagaagaggaaataacagctaaattgtggatttcagtgctttacatggtgcctttcgagtcagcttttacattataggggcttgttatagtttagctaagatgaccacttaacagtttatacagaactcatatgtataaatcaacattcttaggatattatttatatcctttgaataaatccctgtgaagtttttcctccccactaaaatggtgcataataaaacatgaaatatgtagtatgcagatatcatttattagatagtttgtagtgtatacatttagaacatacttcttttgacaaagggtgatctgattgctaatttaccattttattctgtcaggtacaggtgaaacaaattctcatcttgaatgatcagatgcaaaatcatttctgaaccctagagcagaagttagaaataacaaaatggccgtttcaaccttgactggccaaaaataactaataaacttttttgttttaagtcaggcaagtgattttctacatttagcagtttgaaagtccagtgttaatgcaatatttctagtgagaaatgcttgttattaaaagcatgggagtgatagtgtgaaatggtggtgagtgcttctatcatattactgtaggtacttggactggtgcaaacttgattccttttcatccccctgtttaggagctattaaaatattactgttaaaaatccaaaccattctttgttccatgtaataagaaaatagccaaaatcactttagagcttctcaactatttatgaagagctatcctgcttttattgaaagtcactagagttgaatgtggtaagaaaccacttagcctatgtattggacgagaaaatcagtatcatgataaaattttgaattaagagaacccttgtagagtttttaaaaaatgatttattttcaattaggtttaagaaatctatgttatgcagggaggcatatcagatgaatgttgtagcagacaaaagttttaaatcgtgttagacttgaattcatcaattgtttgaatgagggtgggtgggtagaaggataacaaaattactgttagtgtttctttccttacggaaaaagatgtgaatcccagccttatttcagggaagcctttgaagctatgatggacataagtctaaattaaatgtatgtatgtttcattatattgctcttaagactactgaggtggcagtttaattcttaaaaacaataaaatggaagcataaatacta

SEQ ID NO: 115118 - DNA, 573 bp, Homo sapiens
  Payload ID: 2480
  Gene Symbol: CBLL1
  Gene Name: Cbl proto-oncogene-like 1, E3 ubiquitin protein ligase
  ENST ID: ENST00000432748
  CDS Start-End: 23-226
actgtgctctgcgagccgaatcatggatcacactgacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagttctagggccaaaagagtcgtgagaagcctggctccttggagggatatatttgtctgctcagctttactttagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacac

SEQ ID NO: 115119 - DNA, 1506 bp, Homo sapiens
  Payload ID: 2480
  Gene Symbol: CBLL1
  Gene Name: Cbl proto-oncogene-like 1, E3 ubiquitin protein ligase
  ENST ID: ENST00000420796
  CDS Start-End: 539-1506
ggcgatgtaggccttcgggaagggagagccccggctctgttttatttagcccagctgctctggcctacgttatggagactggcgggtagattgcggtctccgagtcgcggaatcctctttacgctgggagtggacgggcgagaatgggttggagacttcctgctgtctcagtcagctttgggcgggtgctgcagtggtcaccccctgtcgtctctccgatcctttatggactagaggggtgaaagaagggagtctgatagagtttttggaatcaaactcggagcagtttttctacctaaaccaaaagcatgccccgcgcttcggctgaggtccttactcatcatttgagggtatttacaaagaggagtttaaaatcaaggcattctcatacttttctccaaacaatgagttacaaggcactaatagttctggatccttgggtggtcttgatgttcgcagacgaattcctataaagctcatctccaaacaagcaaacaaagcgaaacctgcaccgcgaactcaaagaactataaacaggatgcctgcaaaggctccacctggtgatgaagaaggatttgattataatgaagaagaacggtatgactgtaaagggggtgagctgtttgcaaatcagcgaagatttcctggacaccttttttgggactttcagataaacatcttaggtgaaaaggatgatacaccagttcatttctgtgacaagtgtggattgcctattaaaatctatgggagaatgattccatgcaagcatgttttttgctatgactgtgctattttacatgaaaaaaagggagataagatgtgtccaggctgtagtgatcctgtgcagcgaattgagcagtgtacacgaggttctctcttcatgtgtagcattgttcaagggtgcaagagaacatatttgtctcagagagacttacaggctcatatcaaccatcgccatatgagagctggaaaacctgttacccgtgcttcacttgaaaatgttcatcctcctattgccccaccaccaactgaaatccctgagcgttttataatgccaccagacaagcaccatatgagccatattccgccaaagcagcacatcatgatgccaccacctcctttgcaacatgtgccacatgagcactataatcagccacatgaggatattcgtgctcctccagcagaattgtccatggctccacctccacctcgatcggtcagtcaggaaacctttcgtatttcaacaagaaaacacagcaatttaataaccgtccctattcaggatgactcaaattcaggtgctagagaaccaccacctcctgccccagcacctgctcaccatcatcctgaatatcagggtcaaccagtggtatcgcaccctcatcatattatgcctccacagcaacattatgcaccacccccacctcctccaccaccaataagccatccaatgccacatcctccccaggctgcaggtactcctcacttggtatatagccaagctcc

SEQ ID NO: 115120 - DNA, 1231 bp, Homo sapiens
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENST ID: ENST00000246139
  CDS Start-End: 577-1158
acgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaa

SEQ ID NO: 115121 - DNA, 886 bp, Homo sapiens
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENST ID: ENST00000373619
  CDS Start-End: 229-810
ctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagag

SEQ ID NO: 115122 - DNA, 941 bp, Homo sapiens
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENST ID: ENST00000431381
  CDS Start-End: 199-858
gagtccctgcttcgcagagcaccggacttggagtcagagagacctggctgcgaatcccggctccgccactttctagcgctgtgaccttggttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggcc

SEQ ID NO: 115123 - DNA, 666 bp, Homo sapiens
  Payload ID: 2481
  Gene Symbol: CITED1
  Gene Name: Cbp/p300-interacting transactivator, with Glu/Asp-rich carboxy-terminal domain, 1
  ENST ID: ENST00000427412
  CDS Start-End: 252-666
gggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccag

SEQ ID NO: 115124 - DNA, 998 bp, Homo sapiens
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENST ID: ENST00000453707
  CDS Start-End: 254-913
gcaccgctgagctgccgagaggaagctcgctctgcccggctgccctcttgtagtccgccggcgaggggcagttctcggtgaggaggaagagagcagcggacggcacagcacccgcgcgggccctccggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 115125 - DNA, 820 bp, Homo sapiens
  Payload ID: 2481
  Gene Symbol: CITED1
  Gene Name: Cbp/p300-interacting transactivator, with Glu/Asp-rich carboxy-terminal domain, 1
  Uniprot ID: Q99966
  ENST ID: ENST00000445983
  CDS Start-End: 156-737
gagtccctgcttcgcagagcaccggacttggagtcagagagacctggctgcgaatcccggctccgccactttctagcgctgtgaccttggcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggcc

SEQ ID NO: 115126 - DNA, 505 bp, Homo sapiens
  Payload ID: 2481
  Gene Symbol: CITED1
  Gene Name: Cbp/p300-interacting transactivator, with Glu/Asp-rich carboxy-terminal domain, 1
  ENST ID: ENST00000450875
  CDS Start-End: 177-505
cggacttggagtcagagagacctggctgcgaatcccggctccgccactttctagcgctgtgaccttggttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaa

SEQ ID NO: 115127 - DNA, 395 bp, Homo sapiens
  Payload ID: 2481
  Gene Symbol: CITED1
  Gene Name: Cbp/p300-interacting transactivator, with Glu/Asp-rich carboxy-terminal domain, 1
  ENST ID: ENST00000429794
  CDS Start-End: 1-320
tgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaaga

SEQ ID NO: 115128 - DNA, 716 bp, Homo sapiens
  Payload ID: 2481
  Gene Symbol: CITED1
  Gene Name: Cbp/p300-interacting transactivator, with Glu/Asp-rich carboxy-terminal domain, 1
  ENST ID: ENST00000454225
  CDS Start-End: 540-716
aaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaac

SEQ ID NO: 115129 - DNA, 560 bp, Homo sapiens
  Payload ID: 2481
  Gene Symbol: CITED1
  Gene Name: Cbp/p300-interacting transactivator, with Glu/Asp-rich carboxy-terminal domain, 1
  ENST ID: ENST00000417400
  CDS Start-End: 139-560
agcaccggacttggagtcagagagacctggctgcgaatcccggctccgccactttctagcgctgtgaccttggcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctgg

SEQ ID NO: 115130 - DNA, 2354 bp, Homo sapiens
  Payload ID: 2482
  Gene Symbol: CITED2
  Gene Name: Cbp/p300-interacting transactivator, with Glu/Asp-rich carboxy-terminal domain, 2
  Uniprot ID: Q99967
  ENST ID: ENST00000367651
  CDS Start-End: 217-1029
gtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataacttgttttctagaagtcatttgggggtggttgttccctttggtggcttttttccccccgtctttgagttgaacactattgatgagagtaagcattccaaaggataaattacaggacactaaaacaggtcatgatgagcttaagcggagagcaggatttaacataattggcataatgcttcattgttatcattgtaacatgcctcttggtgtgctttaatcaaaagctgcaaagttgtcactgcttttttttttttcttaattgccatcatatcaagtgtactccagagttagaaaggtttgcaatactcaacattatctttttcaatgggcaggaggcaaaaaaaatcaagtgtttctgtttatacctgattcaactacttaaatagaggtagattggaataatacactgattgattgatgggtggcattaaatataaatctaccttta

SEQ ID NO: 115131 - DNA, 1797 bp, Homo sapiens
  Payload ID: 2482
  Gene Symbol: CITED2
  Gene Name: Cbp/p300-interacting transactivator, with Glu/Asp-rich carboxy-terminal domain, 2
  Uniprot ID: Q99967
  ENST ID: ENST00000536159
  CDS Start-End: 108-920
gagggcagggtttgcccggaggaagagcgtgaggcgaagctggggaataacaacaggatgtgcaacaacaggatgaggagggctgatttaatgcctgaagactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataac

SEQ ID NO: 115132 - DNA, 1780 bp, Homo sapiens
  Payload ID: 2482
  Gene Symbol: CITED2
  Gene Name: Cbp/p300-interacting transactivator, with Glu/Asp-rich carboxy-terminal domain, 2
  ENST ID: ENST00000537332
  CDS Start-End: 76-903
caaagggggtgtgggctcgggtccccccgcccgatcgcaggggaaggggctgtttgtgcagcgtccggctgtgttatgagtggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataac

SEQ ID NO: 115133 - DNA, 901 bp, Homo sapiens
  Payload ID: 2482
  Gene Symbol: CITED2
  Gene Name: Cbp/p300-interacting transactivator, with Glu/Asp-rich carboxy-terminal domain, 2
  Uniprot ID: Q99967
  ENST ID: ENST00000618718
  CDS Start-End: 202-843
gagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaa

SEQ ID NO: 115134 - DNA, 1316 bp, Homo sapiens
  Payload ID: 2483
  Gene Symbol: CITED4
  Gene Name: Cbp/p300-interacting transactivator, with Glu/Asp-rich carboxy-terminal domain, 4
  Uniprot ID: Q96RK1
  ENST ID: ENST00000372638
  CDS Start-End: 240-794
gacgcggaggtttcggagcactacaggttgcgggcctttgtgaccccaggctgcggccgcaaggtgcgcagtagtgggctgggccggggcaccagtcgggtttggttttgctccgcccggccgagctgcagggaccgcacggtgcccgggtctcccgccgcagagcagccgctggcccgggccgggggagccggcgctgaccaccgcgcgctgtccccgcaggcagccggcctgccgccatggccgaccacctgatgctcgccgagggctaccgcctggtgcagaggccgccgtccgccgcggccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggcgccaagcgccgcagccccgccgccgcccgcgcacgccctgggcggcatggacgccgaactcatcgacgaggaggcgctgacgtcgctggagctggagctcgggctgcaccgcgtgcgcgagctgcccgagctcttcctgggccagagcgagttcgactgcttctcggacttggggtccgcgccgcccgccggctccgtgagctgctgagggcggccggcgcccgcccggcgtgccggagaggagaaagggcccgactgcccgccggaccctgcacccagcgactgggccccgcgcgcgccctccgcgagggtggaggcggcggctgtgtgcgcagggcccggcaccggactgggaccctggcgtccctccaggccttgcctcctgcgggaggacagtttggcttcacttctctgaccccagcctcggccgtaaagtgaaagagaccggaccagcttcagctttcggactctggttcttggatcgtgtcctctccccctcgccgccctcttcccccaatctgagccattgcaggcctctgcctgctgccccctctctcctcgggatcgggtccccagagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcactttacagtc

SEQ ID NO: 115135 - DNA, 5750 bp, Homo sapiens
  Payload ID: 2484
  Gene Symbol: CTIF
  Gene Name: CBP80/20-dependent translation initiation factor
  Uniprot ID: O43310
  ENST ID: ENST00000256413
  CDS Start-End: 296-2092
ctttccctgtgtcagatcagggatcattttttttccttcctctactccctcccccctacccgcccctccctccctgtttcccttccctccctccctcccctctctgctgggtctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagccttgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtcacggtggctccagacatactgtttgcctagtttattccactgcttgaaagcgcttcctagccaatctgaacaacaacactttaagctgtttttctaaatgcaggttgctgctcctttttcagatatggaaggaaaacgttaagactattttttttttaaagaaacaacagtcaagcctaaaatttgagaccccgaggcagcttcccgagggagactgctcagacaggaactgcaggacagaagtggatgccccacagaccctggccccctccccaagtccatcccctctctgtggcatgaggaaggccgcgtccgagttgacctctgaatgtatgtgatgagaggcagagctggatattgcatttctaaggcttgcattgctttcccctcgcccgcggttcttggcgcatggaagaggcggtccagccatctgatgttgatcctgtctcagtctccccactgcctgtcaggatgagttagtcattgtttttctccgaggcggcctgcttgccacagccctgctccccaaggcctggtggctttgccgaagctctgggaccgcagccccagcgaggcccccaacctcacccagacgaggccaggagccccgccaccctccacgggatgtgcaccctcagaccccattctctctgttcgtccttccttgaccagtctgtaaaccttcactgtttggggatcgtcctgtccatccatgtaaatgtaaatgttggccgagtcggtatttattctgattgatttttattttattctattattttctccgagggatgagggtggggggtgtgggaagggtaccacagatcaggccggggcagctgtaggggcgggggcccagacagccaggccgccaccagagcagccccatggggtgccccagacgcgggcctccaagaagccaagtcccagtctgttttctggcatcagacaccggcccgtgttccttgtcagacagacagactctcaggcctgcctggggagtcgtgtccctcagctgcagggcactgtgttgggaaaccattggctgggcctttgaggacacagatcagaagaaagaaagacaactttcctctgcgcggaacactcacacggaagggctggccgcctccctgagccggctgggagtggacgacaggacctacctccccagagcaagggcctggggcttcccgccaaagctgccgcggaaccccgctagtgcgaccaccctccctccgtcggtatgtcctgctttccagctgaacccaaactacaagtgggtttaaaaaaataaacaccaccaccaaaaacaaaa

SEQ ID NO: 115136 - DNA, 4407 bp, Homo sapiens
  Payload ID: 2484
  Gene Symbol: CTIF
  Gene Name: CBP80/20-dependent translation initiation factor
  Uniprot ID: O43310
  ENST ID: ENST00000382998
  CDS Start-End: 258-2060
ctgtgcgctggggcgcccgatcccctccgcagctgggacgctccgaactcgaggcaggagtcggctctccggagcctcgtccctcccttccccttccctgcccccttcccccacccccgactcgggcttggcgcggcggccagaggaaccccgagcccgcatttgctgcatcgagcagttggtttagtatcagccaaacttgcagctgttcagaccgcgctccgccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaaggcggcagcagagacctccggggggcaacaagccccaacagcatggtgaccaccagccaggcagtgccaaacacaacagggaccaccagaaatcctaccaggggggctcagcaccccacccctcagggaggcccactcaccatggctacagccagaaccggcgctggcaccatggcaacatgaagcacccaccaggcgacaagggggaggcaggcgcacaccgcaatgccaaagagaccatgaccatcgagaacccaaaactggaggacactgcaggggacaccgggcacagcagccttgaggccccccgcagccctgacaccctggccccggtggcttctgagcggctgcccccacagcagtcaggggggccagaggttgagacaaaacgtaaagacagtattcttcccgagcgcatcggggagcggcccaaaattaccctgctccagtcttccaaagacagactgcggcgaaggctaaaggaaaaggtaccggatgaagtggccgtggagacgaccactccccagcagaacaagatggacaagctgatcgagatcctgaacagcatgcggaacaacagcagcgacgtggacaccaagctcaccaccttcatggaggaggcccagaactccaccaactccgaggagatgctgggcgagatcgtgcgcacaatctaccagaaggctgtgtccgaccgcagcttcgccttcaccgctgccaagctctgcgacaagatggcgctctttatggtggaggggaccaagttccggagcctgctcctcaacatgctgcagaaggacttcacggtgcgcgaggagctgcagcagcaggacgtggagcgctggctgggcttcatcaccttcctgtgcgaggtcttcggcaccatgcgcagcagcacaggcgagcccttccgtgtgctcgtgtgccccatctacacctgcctcagggagctcttgcaatctcaggatgtgaaggaagatgctgtcctttgctgctctatggagctgcagagtacaggccggctgctggaggaacagctgcctgagatgatgacagagctcctggccagcgcacgggacaagatgctgtgcccctcggagtccatgctgacccggtcgctgctcctagaggtcatcgagctccacgctaacagctggaaccctctgacgccccccatcacgcagtactacaacagaaccatccagaaactgacagcctgacagccagggggcctggcaggcggcccacgggcagctggggccctggtgcacagggccagatggacaggcgggaggacaggggtggccctggcgggagaaagaaatggggaggagggcaggcagagtcggtggccagtctggagccagacggggaagggagcaaatccctgagaggagtgcccccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgcactcttttgtttattgtgttttatttttcaaaagtcggttgctttgaagtctctttggccaatgaaaatgcccgtgatgtgatcacacagtcagcactgttgaggacccccggattagtgggagatcaaacccagctcccctctagaagaaggattcgagccacagacagcttgccagtagccaattagggtaattggaaacttctgccccggcggggggtccccgctggaatcctgtgttcctcgccactggcttccagcgcctctgttttctcaaagggctgatactgtcaccactgggaccaagttaaacctggtcctggccccaggggccttgtggcaaacagggcacagaacgagactggcaaattaaaaccaaaattctagatggtgtcttgcgctccacacgcaggtcttactggggaaaaggatgggagtgggggctccccaggactcgattttagctaatgcgctgtgtcactgccccagctcggacgtagaagcccagccctccgtgagctcttgggaaaggggtgaattcactgggtcatggaagggacagtcaggtgaccagcggggtcgccagatgaagcttcccagccgggaaacaagacggggtttcttggcaggccctggtcctggggagcaggccctgttgttggctggagaggaaggtgtggggtggaacaggtgtccacatagctccatctctgggggctggagcacacactttgatgagcccccccggaaatgatgtcagagcctagccgcttccttatttgctcttttattgaggccgggcaggccctgggtcactttggaggcccctcttggtccacactggactggccgggaggtgatgggcggggaaggttctcgtgattgattgattctgagtctgagagtggcgagtggggagaggcttccccagttctctccagctttccctgcagctgcaacctgccctctggtcccaggtgtggagcctttgcctgtctctaaaaagagcctgttggcgacaaggtgtagggggcacaagtttacctgaaacaggtcagtggtctctcccaagaagcgcacgccacctctggtccctggccctgaaccctgccttcttcctccctccacggtttcttcccagactttctcaagctcctcctcactgcccttcctccccagcccagcctgggaacacagatgccccgcgggtaggaggcctcgagggaggagccgggctgatgcggggctgctcagggcaggccccagggcgagcttgccatcgtggccaggcagcctccacctgtgcttcagtggcccctgcccccctgaagcatgtggggtttgtccgctaggaggaggcaaggcccccgaagagaggagagacctgggagtgggagctcaggtcagggaggaggcaggggagtggggtctcccagacccaacggtgagctcagagcaagcttcacgcaggacgctccgaaacactgtgtggagggggctgtgttgtgggcaccttggggcctgattctccttcctccgaacgggctccttgatggcctggccacaggggcagctccccattggctgttaggaccagagtgtgaagaagaagtgaaatataaatatgtatacatatataaatatatttttaattacatgtcgtgtca

SEQ ID NO: 115137 - DNA, 683 bp, Homo sapiens
  Payload ID: 2484
  Gene Symbol: CTIF
  Gene Name: CBP80/20-dependent translation initiation factor
  ENST ID: ENST00000587752
  CDS Start-End: 100-683
ccccgcgggctcggggatgtctgtggatggctgtcgtctagacagggcgcagccccctccctgcgtccccgtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgccacacatcgaccgcgaagggtgtggcaaagggaagctggaagatggggatggcatcaacctgaatgacatcgagaaggtccttccagcctggcagggctaccacccgatgccccatgaagtggagatcgcacacaccaagaagctgttccgcaggaggagaaatgatcgaag

SEQ ID NO: 115138 - DNA, 859 bp, Homo sapiens
  Payload ID: 2484
  Gene Symbol: CTIF
  Gene Name: CBP80/20-dependent translation initiation factor
  ENST ID: ENST00000591387
  CDS Start-End: 446-859
aaatccgggaaaaccgccccaaacaatcagcccccttccccccatccctgctcctgggccagcggggtgtccgcacccatctaccatcccctcctccccctcggtggggaactgcactccacagtgtcgccccctccctgggtttgtcccattccctgccgggttccccgccccgcggggtgtcgtggccctggagctccggcgccaaggggggctcttgggggacgcacggctggagcccggctcgctttggagctgcgcggtgtagccgctgtcatgtgccgggttccgacctgggaggaggaaaagagcgagcgcgattcctctcccttttgttttgaagcccgcatttgctgcatcgagcagttggtttagtatcagccaaacttgcagctgttcagaccgcgctccgccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacaccttcgattccttcagtggtgccacctgggacctgcagccggaaaagctggacttcacccagttccaccgcaaagtccgacacacgcccaagcagcccctgcca

SEQ ID NO: 115139 - DNA, 584 bp, Homo sapiens
  Payload ID: 2484
  Gene Symbol: CTIF
  Gene Name: CBP80/20-dependent translation initiation factor
  ENST ID: ENST00000588345
  CDS Start-End: 272-584
agcagaggaagaaaccaaatcggtggacccgttgcggtctcccctttggttattcccaacggttgtggttctgttggctttttttattattcctgtcgctgcggtgcaatcgggcctggggaatagatacgcccggcggagaggggttcacttgacaggctctgaaaagccacctctgggtggcgagtgacccgagaggccgtggggtgggctccggctcgggttcatcaggacgacgagcagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccagtggacagcggactgcagcgaaccgctggacagcagctgttccttctcccgagggcgagcccccccacagcagaatggcagcaaagacaactctctggacatgctgggcacggacatctgggcggccaacacct

SEQ ID NO: 115140 - DNA, 491 bp, Homo sapiens
  Payload ID: 2484
  Gene Symbol: CTIF
  Gene Name: CBP80/20-dependent translation initiation factor
  ENST ID: ENST00000591412
  CDS Start-End: 132-491
ggcaggagtcggctctccggagcctcgtccctcccttccccttccctgcccccttcccccacccccgactcgggcttggcgcggcggccagaggaaccccgagtcccggcccaggcccctgagctggagggatggaaaactcctctgcagcatcagcctcctcggaggcagggagcagccgctcccaggagatcgaggagctggagcgcttcatcgacagctacgtgctggagtaccaggtgcaggggctgctggctgacaagacggagggtgatggcgagagcgagaggacccagtcccacatctcccaggaggaagtactcaatggtggaccacccatgaaaggcttaacagaagaatggacagcggactgcagcgaaccgctggacagcagctgttccttctcccgagggcgagcccccccacagcagaatggcagcaaagacaactctctggacatgctgggcacggacatctgggcggccaacacc

SEQ ID NO: 115141 - DNA, 491 bp, Homo sapiens; identical to SEQ ID NO: 115140
  Payload ID: 2484
  Gene Symbol: CTIF
  Gene Name: CBP80/20-dependent translation initiation factor
  ENST ID: ENST00000635283
  CDS Start-End: 132-491

SEQ ID NO: 115142 - DNA, 683 bp, Homo sapiens; identical to SEQ ID NO: 115137
  Payload ID: 2484
  Gene Symbol: CTIF
  Gene Name: CBP80/20-dependent translation initiation factor
  ENST ID: ENST00000634755
  CDS Start-End: 100-683

SEQ ID NO: 115143 - DNA, 584 bp, Homo sapiens; identical to SEQ ID NO: 115139
  Payload ID: 2484
  Gene Symbol: CTIF
  Gene Name: CBP80/20-dependent translation initiation factor
  ENST ID: ENST00000634324
  CDS Start-End: 272-584

SEQ ID NO: 115144 - DNA, 4407 bp, Homo sapiens; identical to SEQ ID NO: 115136
  Payload ID: 2484
  Gene Symbol: CTIF
  Gene Name: CBP80/20-dependent translation initiation factor
  ENST ID: ENST00000634350
  CDS Start-End: 258-2060

SEQ ID NO: 115145 - DNA, 859 bp, Homo sapiens; identical to SEQ ID NO: 115138
  Payload ID: 2484
  Gene Symbol: CTIF
  Gene Name: CBP80/20-dependent translation initiation factor
  ENST ID: ENST00000635367
  CDS Start-End: 446-859

SEQ ID NO: 115146 - DNA, 5750 bp, Homo sapiens; identical to SEQ ID NO: 115135
  Payload ID: 2484
  Gene Symbol: CTIF
  Gene Name: CBP80/20-dependent translation initiation factor
  ENST ID: ENST00000635228
  CDS Start-End: 296-2092

SEQ ID NO: 115147 - DNA, 2631 bp, Homo sapiens
  Payload ID: 2485
  Gene Symbol: CEBPA
  Gene Name: CCAAT/enhancer binding protein (C/EBP), alpha
  Uniprot ID: P49715
  ENST ID: ENST00000498907
  CDS Start-End: 151-1227
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaa

SEQ ID NO: 115148 - DNA, 1956 bp, Homo sapiens
  Payload ID: 2486
  Gene Symbol: CEBPB
  Gene Name: CCAAT/enhancer binding protein (C/EBP), beta
  Uniprot ID: P17676
  ENST ID: ENST00000303004
  CDS Start-End: 301-1338
gtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagccttttgggggcagta

SEQ ID NO: 115149 - DNA, 2178 bp, Homo sapiens
  Payload ID: 2487
  Gene Symbol: CEBPD
  Gene Name: CCAAT/enhancer binding protein (C/EBP), delta
  Uniprot ID: P49716
  ENST ID: ENST00000408965
  CDS Start-End: 967-1776
gatgccgccacacgatggcactgcttccgtagacctggaagaaacgcgggcgcgggagctggcggcggacgcccgggtctgcggggtcggggagtagcgtccggccggagagcccgcacctcgaggagccggcggaggacgcggtgtcgtgaccgcgtctcccccatctgctctgcttttggcgacagcgtcccgtcggcctttcggccaggacgcagcagccgcgtctctgggcctcgacccccagggccggccggacccgggacctccgaggagagcagcgagaaccggcccggattccccgaggcgcccgagtgcggtgcgggcagccctccccgcctgccaggccgccgctgtccccacgtctggtcccccacgcctcttcccgcatctggtcccacggtggaggcgcggggcgagggcctcacgcgcgtgcccacggtcggggggcgtccttggacgcgcgggtcctctcccacgggtctccaccccccgccctccggcgacaggagccggcctgggacgcgcgcgctgcggccaagtcctggttttgatttcactcccaaccccgaggagcgaggaggttccaagcccacaaacaggaagaagagaaggccctggagtgctggcagagggagtgtcattcccagcagcgcagcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgcccct

SEQ ID NO: 115150 - DNA, 1554 bp, Homo sapiens
  Payload ID: 2488
  Gene Symbol: CEBPE
  Gene Name: CCAAT/enhancer binding protein (C/EBP), epsilon
  Uniprot ID: Q15744
  ENST ID: ENST00000206513
  CDS Start-End: 526-1371
ggaacctcattctgcatagaactttttcaaagtcggagggaggaggttgctcagagtggggtgttgccctctgcgaggatttggagtcccctggcctcccagcagggagtggagaggcattcccagaagcatcagcttcgggcatctccagaaccctggcttggtccctgaccaaggagtgtccccaactgctgaataggccaggagtcgcctttctctaaggcttacatctctccctctggggtgtgtcctgcccctccctgagtcaccccaaggggagagaggggaaaaaagggaagagaagagaggcattgactacagaggaaggaaaaggaagcagagcagaggggggagagaggccacacaggagtgggtgacagaggagactgcagagggcaggtctagggcagaagatcgagagagggcaggcccaggtcaggaggaggtagagagagggcagccggagcaccccaaggggtgcctcaagagcaggtgggggcggggagccgagggggcgggccggccatgtcccacgggacctactacgagtgtgagccccggggtggccagcagccactcgagttctcagggggccgagctgggcccggggagctaggggacatgtgtgagcatgaggcctccattgacctctccgcctacatcgagtctggggaagagcagcttctctccgatctctttgccgtgaagccagcgcctgaggccagaggcctcaagggccccggaacccctgccttcccccactacttgccgcctgaccctcggccctttgcctaccctccacataccttcggcccagacaggaaggcgctggggcctggcatctacagcagcccagggagctacgaccccagggctgtggcggtgaaggaggagccccgggggccagagggcagccgagctgccagccgaggcagctacaatcccctgcagtaccaagtggcacactgtgggcagacagccatgcacctgcccccaactctggcagcacccggccagcctctgcgcgttctcaaggcccctttggccactgccgcacccccctgcagtcccctcctgaaggcgccctccccggctggccccttacacaagggcaagaaggcagtgaacaaagatagccttgagtaccggctgaggcgggagcgcaacaacatcgccgtgcgcaagagccgagacaaggccaagaggcgcattctggagacgcagcagaaggtgctggagtacatggcagagaacgagcgcctccgcagccgcgtggagcagctcacccaggagctagacaccctccgcaacctcttccgccagattcctgaggcggccaacctcatcaagggcgtggggggttgcagctgaggctggctggtggattgtgggcaccaggctccctggcacggcctaactctgcggacccccatcctgctgggggcctagaaccctgagacatagaccatggataaatggcaaccggggtggcaaagagggcaggacccagcataatgattatatggctgaataaagttgcactgtgactgggtg

SEQ ID NO: 115151 - DNA, 4109 bp, Homo sapiens
  Payload ID: 2489
  Gene Symbol: CEBPG
  Gene Name: CCAAT/enhancer binding protein (C/EBP), gamma
  Uniprot ID: P53567
  ENST ID: ENST00000284000
  CDS Start-End: 663-1115
ccgcgggggcttccaagggacgcggcgaaaccaaaacagtcgccggtggttcacaaaaccacctcagaaaatgcttccaaaggcacgtctggcctccacaaggtgacggcttttcagcctccgactcgaacttgagtcgtccacagcactaggccgccgccagcccgggcgagctgcctagggaccgcggacgccgcagcaagcagctccctgctcccgccacacccgccgagccagccgcgcggaacccactcccccaccgtgggcccgcctcccgccgccagcctgcccacgattggtcgactgggctgcccgtcgcgagagaaggcggtgcctccggcaggccggcgctcccattggccgggatggcggcggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaatga

SEQ ID NO: 115152 - DNA, 3845 bp, Homo sapiens
  Payload ID: 2489
  Gene Symbol: CEBPG
  Gene Name: CCAAT/enhancer binding protein (C/EBP), gamma
  Uniprot ID: P53567
  ENST ID: ENST00000585933
  CDS Start-End: 399-851
gaaggtggaccgagtcgagctttagaatcctgatcttctagaagggctcagcttgcggtgatcgaaaatctgttcagaagttcaaagactgatcaataaaatagggaaagcaactggtttttaaatgcatgactttgcagagataatattttgcttctttgtggagctgttggaatgtcctgcactttactgttgaacgtagtttagaagaacacgcaacacctacgggtcgaatagagaagaaatgaagcacttcgcaggcatagttggagggagcggagcagggccgacagccagcggaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaatga

SEQ ID NO: 115153 - DNA, 3463 bp, Homo sapiens
  Payload ID: 2490
  Gene Symbol: CEBPZ
  Gene Name: CCAAT/enhancer binding protein (C/EBP), zeta
  Uniprot ID: Q03701
  ENST ID: ENST00000234170
  CDS Start-End: 147-3311
acactcatgctgaaattcgcaggctagctcgctccgccaggagctggggcttagaccatttccgggagaagacacgccccgacaggaattacgccactggcagagcggaaataggctgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaatagctctcatttataaa

SEQ ID NO: 115154 - DNA, 526 bp, Homo sapiens
  Payload ID: 2490
  Gene Symbol: CEBPZ
  Gene Name: CCAAT/enhancer binding protein (C/EBP), zeta
  ENST ID: ENST00000446769
  CDS Start-End: 89-526
gttccgaaggtggctaggctgactgccccgccgcttccgcgctgcgtagagcgcgggcgtccaggaccgagatcccagcctctgaagcatgtgttcgcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaa

SEQ ID NO: 115155 - DNA, 3217 bp, Homo sapiens
  Payload ID: 2490
  Gene Symbol: CEBPZ
  Gene Name: CCAAT/enhancer binding protein (C/EBP), zeta
  ENST ID: ENST00000619061
  CDS Start-End: 13-3009
gctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattgcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatct

SEQ ID NO: 115156 - DNA, 3939 bp, Homo sapiens
  Payload ID: 2491
  Gene Symbol: CTCF
  Gene Name: CCCTC-binding factor (zinc finger protein)
  Uniprot ID: P49711
  ENST ID: ENST00000264010
  CDS Start-End: 445-2628
cccatgctgccctgcgccaacccctcccctcacctttcctcccccgccctctactcgccgcccggccggtccccccacccgtcccttcccttatcagcacccgcggccccggcagcgccgacgcaggcgcactgcaccgcgccgccgccattttgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaa

SEQ ID NO: 115157 - DNA, 2978 bp, Homo sapiens
  Payload ID: 2491
  Gene Symbol: CTCF
  Gene Name: CCCTC-binding factor (zinc finger protein)
  Uniprot ID: P49711
  ENST ID: ENST00000401394
  CDS Start-End: 468-1667
cccatgctgccctgcgccaacccctcccctcacctttcctcccccgccctctactcgccgcccggccggtccccccacccgtcccttcccttatcagcacccgcggccccggcagcgccgacgcaggcgcactgcaccgcgccgccgccattttgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaa

SEQ ID NO: 115158 - DNA, 3567 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000243914
  CDS Start-End: 194-2185
aaccctgcctggctccgcccccttcacgccccctcttttccgctccgcgcctgcgcactgccaccctccactctcgcgccagcccggcggcggccggctgtgggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgc

SEQ ID NO: 115159 - DNA, 3491 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000371196
  CDS Start-End: 118-2109
tctcccaggccccctgcaggccctcgtgccctccttacttcccccccgggtctcccagcgccccctgcggggccctcctcccttcctcatccacttcaaccccaaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgc

SEQ ID NO: 115160 - DNA, 2234 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000433949
  CDS Start-End: 153-1535
ggctgcagcacgcggtgcacgaggcagagcccacaagccaaagacggagtgggccgagcattccggccacgccttccgcgctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 115161 - DNA, 2966 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000422869
  CDS Start-End: 191-1912
attccacccctccccccagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattacctcaaaatggagtggcttaaaaccacaaacatttatcacctgacagattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 115162 - DNA, 3996 bp, Homo sapiens
  Payload ID: 2492
  Gene Symbol: CTCFL
  Gene Name: CCCTC-binding factor (zinc finger protein)-like
  ENST ID: ENST00000426658
  CDS Start-End: 663-2018
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgattcctgggcctcccttttccatgatcttatttctctttccaaaatatatgacactgtgatacacaaaaatatgttagcagaacaaaaaatttgacccttttgcccaaagagattctggagatgagatgaatttttttgaaaacctttctgaaaggcgaaaggtgttccacaaagtcttcacttttatttttcatctggaccattctgtcattgttgccgtagataccagcacatcacaaaacacagtccagtggggcttggtggggcacaagtctagccagttgctagacttttttgacaccatggcaaagtaacatggtttatatccatctcatgccagtgggtgatacactccacatagccctataagatgctttataaacacattaattcttccttcccatgactgtatgagaaatcaagctctctaaatgtctgagtcactgtgggtaaggtggagtagctccatcacacagctgtccattgtcatttggcttcttacacaagtatcacaagaccatcatgctttagacttagatgagcaaacccagccagaccttaccatgtgtctcaggttaatttcaacataggaaataacagggcactgacttctaacaacgagtggattatttaaggtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 115163 - DNA, 2955 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000432255
  CDS Start-End: 663-2114
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 115164 - DNA, 2964 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000422109
  CDS Start-End: 663-1946
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 115165 - DNA, 3864 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000429804
  CDS Start-End: 637-2478
attccacccctccccccagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaaggtatttccgtgcccctgcaggaccctcctcccctccttaggcgctcccccactacccagtcttccagtgccctgcaggctctcctcctctccttatccacccccaccccaggtctcccagtgccctgtatgggaccctcctcccctcctcatccacccccccaggtccaccagtgccccctctggggtcctcctcatccgtgctccccctccccctccctactccccttcccccctgcccccacagtacatcaccccctcccccaaccctgcctggctccgcccccttcacgccccctcttttccgctccgcgcctgcgcactgccaccctccactctcgcgccagcccggcggcggccggctgtgggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgctata

SEQ ID NO: 115166 - DNA, 2478 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000423479
  CDS Start-End: 92-2194
ggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataattccgcaggctgtacaggaaggatgatgttggtatctgcctggcttctggggaggcctcaggaaacttacaatcaaggcagaaggcgaagagggagtaggcgcgtcacatggtgaaagcaggagcgagagagggggaggcgccacactcctctgaacgaccagattccttgagaaccgccactgtcatgaggacagcaccaagcggatggtgctaaatcattcctaagaaaccgcccccgtgatccagtcacctcctaccaggccccacctccaacactggggattacaattcaacatgagctttggccagggacaaatatccaaactatatcatgtattttactacaaccaaatgtatgttaatttcaaaaacagataacataaatatgtttgaaaac

SEQ ID NO: 115167 - DNA, 2023 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000502686
  CDS Start-End: 113-1324
ggctgcagcacgcggtgcacgaggcagagcccacaagccaaagacggagtgggccgagcattccggccacgccttccgcggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 115168 - DNA, 2262 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000539382
  CDS Start-End: 153-1421
ggctgcagcacgcggtgcacgaggcagagcccacaagccaaagacggagtgggccgagcattccggccacgccttccgcgctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 115169 - DNA, 3668 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000609232
  CDS Start-End: 291-2282
attccacccctccccccagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaagcccggcggcggccggctgtgggctgcagcacgcggtgcacgaggcagagcccacaagccaaagacggagtgggccgagcattccggccacgccttccgcggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgctata

SEQ ID NO: 115170 - DNA, 2915 bp, Homo sapiens
  Payload ID: 2492
  Gene Symbol: CTCFL
  Gene Name: CCCTC-binding factor (zinc finger protein)-like
  ENST ID: ENST00000608425
  CDS Start-End: 191-2074
attccacccctccccccagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 115171 - DNA, 1512 bp, Homo sapiens
  Payload ID: 2492
  Gene Symbol: CTCFL
  Gene Name: CCCTC-binding factor (zinc finger protein)-like
  ENST ID: ENST00000481655
  CDS Start-End: 191-1405
attccacccctccccccagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggtaaagccattcttggacttgaagcttcatggcatcttagtagaggctgctgtacaagttactccaagtgtaactaacagtagaatctgttacaaacaggctttttattattcatataaaatttatgcaggaaataatatgcattctcttttatgaagttaaaatagaaaattggatttctttgtttctttgattactaattagtgaaaataatatgtaaaggtttacaaattacaaataaaccatctgtggtcaagaaataa

SEQ ID NO: 115172 - DNA, 2135 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000608903
  CDS Start-End: 113-1012
ggctgcagcacgcggtgcacgaggcagagcccacaagccaaagacggagtgggccgagcattccggccacgccttccgcggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctgggtgttgtattagttatctatttctgtatgacagattacctcaaaatggagtggcttaaaaccacaaacatttatcacctgacagattctctgggttgggaactcggaagtggctgaactgggtggtcctggctcagggccactcctgaggctgcagtcaggatgtccgccagggctgcatcatccgaaggctggactggggccagaggatccacttccaggacagctccgccacacaactgctggcaccggcctcagttccttgctacagggacctctctgcagggctgcttgagtgtcctcctgactcagagcaagtgagagagtgcaagtaggaagccatggtgccttttgcagtctagtcctaaaagcggcacaacagccagctgtgggggctcacacctgtaatcccagtacttcgggaggccaaggcaggtggataacttgaggccaggagctcaagaccagcctggccaacatggtgaaaccctgtctctactttaaaaaaaaaaaaagaaaatagctaggcgtggtagtgcacgcttgtaatcccagctacttgggtggttgggacgggaggatcacttgaacccaggagacagaggttgcagtgagctgagattgtgccactggcctccagcctgggcgacagagcaagactctgtctcaaaaaaaaaaaaaaagtggcacattctagtcacaagaaatgaaccatgaagtcccacccacactcgagtggggaatgaagtttcttttgaaaggaacagcatcaaagaatttcaggacatttaaaaaccactgcacatggctagctagatccttggaccatgtaggcttcagcctaactttataaaagttttataaaagttgaatttcctgaagttgactatttttttaaaaatatttcttcttaaaacagtagtgtagttgtgtttttctgagtagcacagtgggatagttctggaatgtcaaccctattagtttaaaatttcaaataaaagctgtggcagtgctcccaaaacaccattgctcatgcaaaaattgtgaagagttaaaattaacgagtagaattctaaagagaaaaaaactgctctttggtgcaagaaataaaaatgtagagaaaagaacaagtctgc

SEQ ID NO: 115173 - DNA, 4040 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000608263
  CDS Start-End: 663-2654
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacgaagctgctgctgaggaggcttccaccacgaagggagaacagttcccaggagagatgtttcctgtcgcctgcagagaaaccacagccagagtcaaagaggaagtggatgaaggcgtgacctgtgaaatgctcctcaacacgatggataagtgagagggattcgggttgcgtgttcactgcccccaattcctaaagcaagttagaagtttttagcatttaaggtgtgaaatgctcctcaacacgatggataagtgagagagagtcaggttgcatgttcactgcccctaattcctaaagcaagttagaaatttttagcattttctttgaaacaattaagttcatgacaatggatgacacaagtttgaggtagtgtctagaattgttctcctgtttgtagctggatatttcaaagaaacattgcaggtattttataaaagttttaaaccttgaatgagagggtaacacctcaaacctatggattcattcacttgatattggcaaggtggcccacaatgagtgagtagtgatttttggatatttcaaaatagtctagaccagctagtgcttccacagtcaaagctggacatttttatgttgcattatatacacccatgatatttctaataatatatggttttaaacattaaagacaaatgtttttatacaaatgaattttctacaaaatttaaagctaccataatgcttttaattagttctaaattcaaccaaaaaatgttttactcttataaaaaggaaaactgagtaggaaatgaaatactagattagactagaaaataaggaataaatcgattttactttggtataggagcaaggttcacctttagatttttgtattctcttttaattatgctccttggcaggtatgaaattgccctggttacattccattattgcttattagtatttcactccataacccttttttctgctaaaactactctttttatatttgtaaaataattggcagagtgagaagaaacataaaatcagataaggcaaatgtgtacctgtaaggaatttgtactttttcataatgcccagtgattagtgagtatttcccttttgccagttgacaagatttttccaccctcgagcagcgtgagagatgcctctttaacacttgaaattcatttctatctggatacagaggcagatttttcttcattgcttagttgagcagtttgttttgctgccaacctgtctccacccctgtatttcaagatcattgataagccctaaattcaaattcttaagatatggaccttttattgaaaatatcacaagttcagaatccctatacaatgtgaatatgtggaaataatttcccagcaggaagagcattatattctctttgtaccagcaaattaatttaactcaactcacatgagatttaaattctgtgggctgtagtatgccatcattgtgactgaatttgtgcaatggtttcttaatttttttactgttatttaaagatgttttacataattcaataaaatgaaatgacttaaaattgctata

SEQ ID NO: 115174 - DNA, 1984 bp, Homo sapiens
  Payload ID: 2492
  Gene Symbol: CTCFL
  Gene Name: CCCTC-binding factor (zinc finger protein)-like
  ENST ID: ENST00000608158
  CDS Start-End: 663-1877
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggtaaagccattcttggacttgaagcttcatggcatcttagtagaggctgctgtacaagttactccaagtgtaactaacagtagaatctgttacaaacaggctttttattattcatataaaatttatgcaggaaataatatgcattctcttttatgaagttaaaatagaaaattggatttctttgtttctttgattactaattagtgaaaataatatgtaaaggtttacaaattacaaataaaccatctgtggtcaagaaataa

SEQ ID NO: 115175 - DNA, 2241 bp, Homo sapiens
  Payload ID: 2492
  Gene Symbol: CTCFL
  Gene Name: CCCTC-binding factor (zinc finger protein)-like
  ENST ID: ENST00000608720
  CDS Start-End: 663-1943
agggtaaagcaggggccctgccaggcctccgagggagtgtgcttggtctggccgagggctgcttggccaagtctgggtgggctcgaggccactaggcccaaagcctgcctggctctgagggtgctaggtctagaaccgtgcacgaggggaatgcctgctcgggcccgaacctcgctgggcgccgggtgtgcactggcccggggcctgcttggacctgaaacttgctaggcccaggatatgcactggccgagagcctgctgggcccaaaccttactaggcccaggatgttcactgactgaaccggctcaggcctaaccttgctaggcccaggatatgcactgggccagagtgtgctcaggcggaaccttgccaggcgcaggatgtgtgctggccctaagcctgctgaggcccaaacctgttcgttctagggttttgtacaaaatcctgctttagcctaaatcctgcttagccttgaccccctcctagacccaagccagatcagcattgttctgaccctactaagtccaaaaccttttgaggccagaccttgtttcaactccaaagcctgctaggttccagcaccccccgcatccctcctcataccacccccttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtaagggctctggtgctgaaggcctgatacctacagtgttaactcttaaagcaagctttaaaaaattactttttattggcacaattaaagttcaaaggtaaaagtggatttttgcgtgccttcatgataaaagaatcttgatctgtacttttacctttatttagcagtaagagagtctgcatagatactgtgccacaaccccactgtgtggagtaaaacacaaagtatttgcttccgtagatttttcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctac

SEQ ID NO: 115176 - DNA, 2749 bp, Homo sapiens
  Payload ID: 2492
  Gene Symbol: CTCFL
  Gene Name: CCCTC-binding factor (zinc finger protein)-like
  Uniprot ID: Q8NI51
  ENST ID: ENST00000608440
  CDS Start-End: 53-2050
ttctcccccctatggaaaccgcttgcttatttttcaaacaggccaagtcattatggcagccactgagatctctgtcctttctgagcaattcaccaagatcaaagaactcgagttgatgccggaaaaaggcctgaaggaggaggaaaaagacggagtgtgcagagagaaagaccatcggagccctagtgagttggaggccgagcgtacctctggggccttccaggacagcgtcctggaggaagaagtggagctggtgctggccccctcggaggagagcgagaagtacatcctgaccctgcagacggtgcacttcacttctgaagctgtggagttgcaggatatgagcttgctgagcatacagcagcaagaaggggtgcaggtggtggtgcaacagcctggccctgggttgctgtggcttgaggaagggccccggcagagcctgcagcagtgtgtggccattagtatccagcaagagctgtactccccgcaagagatggaggtgttgcagttccacgctctagaggagaatgtgatggtggccagtgaagacagtaagttagcggtgagcctggctgaaactactggactgatcaagctcgaggaagagcaggagaagaaccagttattggctgaaagaacaaaggagcagctcttttttgtggaaacaatgtcaggagatgaaagaagtgacgaaattgttctcacagtttcaaattcaaatgtggaagaacaagaggatcaacctacagctggtcaagcagatgctgaaaaggccaaatctacaaaaaatcaaagaaagacaaagggagcaaaaggaaccttccactgtgatgtctgcatgttcacctcttctagaatgtcaagttttaatcgtcatatgaaaactcacaccagtgagaagcctcacctgtgtcacctctgcctgaaaaccttccgtacggtcactctgctgcggaaccatgttaacacccacacaggaaccaggccctacaagtgtaacgactgcaacatggcatttgtcaccagtggagaactcgtccgacacaggcgctataaacatactcatgagaaaccctttaaatgttccatgtgcaagtatgccagtgtggaggcaagtaaattgaagcgccatgtccgatcccacactggggagcgcccctttcagtgttgccagtgcagctatgccagcagagatacctacaagctgaaacgccacatgagaacgcactcaggtgagaagccttacgaatgccacatctgccacacccgcttcacccagagcgggaccatgaaaatacatattctgcagaaacacggcgaaaatgtccccaaataccagtgtccccattgtgccaccatcattgcacggaaaagcgacctacgtgtgcatatgcgcaacttgcatgcttacagcgctgcagagctgaaatgccgctactgttctgctgtcttccatgaacgctatgccctcattcagcaccagaaaactcataagaatgagaagaggttcaagtgcaaacactgcagttatgcctgcaagcaggaacgtcatatgaccgctcacattcgtacccacactggagagaaaccattcacctgcctttcttgcaataaatgtttccgacagaagcaacttctaaacgctcacttcaggaaataccacgatgcaaatttcatcccgactgtttacaaatgctccaagtgtggcaaaggcttttcccgctggattaacctgcacagacattcggagaagtgtggatcaggggaagcaaagtcggctgcttcaggaaagggaagaagaacaagaaagaggaagcagaccatcctgaaggaagccacaaagggtcagaaggaagctgcgaagggatggaaggaagccgcgaacggagacggtgtgatctcagctcaccgcaacctctgcctcctgggttcaagtgattctcatgcctcagtctccggagctgggattacagatgcccgccaccacgcctggctaattgttctattatttttagtagagatggggttttaccatgtctctcactcctgacctcaagtgatctgcccgcctcggcctcccaaagtggtgggattacaggcatgagcccctgtgcctggcctgatggcaccagttttgtggatctcagtgtttcttttcatatccaagaactgggtcttcttgtctccctccatccaccaaaaaaaaaaaaaaaaaaatacttcaaggaagcatggacaaaaatatcctcagacaagttagaacatgagacagtcacgttcttcagtgtggcgctctgtggatgtttgggaaagtaatttggaaaatgagtagagcagggctccccaaccccccagccgtggacctgtgggctgttaggaactgggcctcccagcaggaggtgagcagtgggtgagggagtgaagctttgtattgacagccgctccccatcgggcgcatcaccgcctgagctccgcctcctgtcagatcagcggcagcgttagattctcatgagtgtgaaccctgttgtgaactctgcacgtgcaagggatctaggctgcacactccttacgagaatctaatgcccgacgatctgtcactgtctcccatcacccccagatgggactgtctagatgcaggaaaacaagcccagggctcccactgattctacattatggtgagctgtataattatttcattatatatcacaatgtaataataaaaataaagtacataagaaatgtaatgtgc

SEQ ID NO: 115177 - DNA, 2051 bp, Homo sapiens
  Payload ID: 2493
  Gene Symbol: CCDC169-SOHLH2
  Gene Name: CCDC169-SOHLH2 readthrough
  ENST ID: ENST00000511166
  CDS Start-End: 303-1811
aggtgcgaccggggggcggttggggttcaccgcctcgtgccgtactggcttctgggtggcccttaatgtcttgtgctctaaggtgctgaggggaaagacgcgggaggtctctggcctgacactatgaaggaagagagaaactacaacttcgacggtgtgagcaccaaccgcctgaaacagcagttgctggaagaagtccgcaagaagtagtgaatggaaaacccgttatgagacacaacttgaattaaatgatgaactagaaaagcaaattgtttatctcaaggagaaagtggaaaaaatccatggaaactcttcaggaatccttaaacacattacttaaacagctagaagaagaaaagaagactcttgaaagtcaagtgaaatactatgcacttaaactggaacaagaatcaaaggcttaccagaagatcaacaatgaacgccgtacatacctagctgaaatgtctcagggttctggtttacatcaagtttctaaaaggcaacaggtggatcaactgcctaggatgcaagagaatctagtgaaaaccctcctcttaaaagaagaattggaccctttaaaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaaactaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctgactaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccag

SEQ ID NO: 115178 - DNA, 1641 bp, Homo sapiens
  Payload ID: 2494
  Gene Symbol: CNBP
  Gene Name: CCHC-type zinc finger, nucleic acid binding protein
  Uniprot ID: P62633
  ENST ID: ENST00000451728
  CDS Start-End: 139-675
cgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtttccagtttgtttcctcgtctcttccagacatttgttatcgctgtggtgagtctggtcatcttgccaaggattgtgatcttcaggaggatgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactg

SEQ ID NO: 115179 - DNA, 1623 bp, Homo sapiens
  Payload ID: 2494
  Gene Symbol: CNBP
  Gene Name: CCHC-type zinc finger, nucleic acid binding protein
  Uniprot ID: P62633
  ENST ID: ENST00000446936
  CDS Start-End: 139-657
cgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagacatttgttatcgctgtggtgagtctggtcatcttgccaaggattgtgatcttcaggaggatgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactg

SEQ ID NO: 115180 - DNA, 1664 bp, Homo sapiens
  Payload ID: 2494
  Gene Symbol: CNBP
  Gene Name: CCHC-type zinc finger, nucleic acid binding protein
  Uniprot ID: P62633
  ENST ID: ENST00000422453
  CDS Start-End: 162-695
gtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtttccagtttgtttcctcgtctcttccagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaa

SEQ ID NO: 115181 - DNA, 1040 bp, Homo sapiens
  Payload ID: 2494
  Gene Symbol: CNBP
  Gene Name: CCHC-type zinc finger, nucleic acid binding protein
  Uniprot ID: P62633
  ENST ID: ENST00000441626
  CDS Start-End: 150-689
gtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtttccagtttgtttcctcgtctcttccagacatttgttatcgctgtggtgagtctggtcatcttgccaaggattgtgatcttcaggaggatgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctgga

SEQ ID NO: 115182 - DNA, 1626 bp, Homo sapiens
  Payload ID: 2494
  Gene Symbol: CNBP
  Gene Name: CCHC-type zinc finger, nucleic acid binding protein
  Uniprot ID: P62633
  ENST ID: ENST00000502976
  CDS Start-End: 145-657
tggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtttccagtttgtttcctcgtctcttccagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaa

SEQ ID NO: 115183 - DNA, 1549 bp, Homo sapiens
  Payload ID: 2494
  Gene Symbol: CNBP
  Gene Name: CCHC-type zinc finger, nucleic acid binding protein
  Uniprot ID: P62633
  ENST ID: ENST00000504813
  CDS Start-End: 162-665
gtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgact

SEQ ID NO: 115184 - DNA, 502 bp, Homo sapiens
  Payload ID: 2494
  Gene Symbol: CNBP
  Gene Name: CCHC-type zinc finger, nucleic acid binding protein
  ENST ID: ENST00000512338
  CDS Start-End: 162-502
gtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggtttccagtttgtttcctcgtctcttccagacatttgttatcgctgtggtgagtctggtcatcttgccaaggattgtgatcttcaggaggatgtcttggcctgtttcttttccttattgttgaagcctgctataactgcggtagaggtggccacattgccaaggactgcaaggagcccaagagagagcgagagcaatgctgctacaactgtggcaaaccaggccatctggctcgt

SEQ ID NO: 115185 - DNA, 1516 bp, Homo sapiens
  Payload ID: 2494
  Gene Symbol: CNBP
  Gene Name: CCHC-type zinc finger, nucleic acid binding protein
  Uniprot ID: P62633
  ENST ID: ENST00000500450
  CDS Start-End: 150-632
gtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgact

SEQ ID NO: 115186 - DNA, 999 bp, Homo sapiens
  Payload ID: 2495
  Gene Symbol: CCL15-CCL14
  Gene Name: CCL15-CCL14 readthrough (NMD candidate)
  ENST ID: ENST00000616694
  CDS Start-End: 130-471
ctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 115187 - DNA, 977 bp, Homo sapiens
  Payload ID: 2495
  Gene Symbol: CCL15-CCL14
  Gene Name: CCL15-CCL14 readthrough (NMD candidate)
  ENST ID: ENST00000610751
  CDS Start-End: 60-401
ggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacaaactggggggaaaccgaaggttgttaaaatacagctaaagttggtggggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 115188 - DNA, 977 bp, Homo sapiens
  Payload ID: 2495
  Gene Symbol: CCL15-CCL14
  Gene Name: CCL15-CCL14 readthrough (NMD candidate)
  ENST ID: ENST00000632208
  CDS Start-End: 60-401
ggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacaaactggggggaaaccgaaggttgttaaaatacagctaaagttggtggggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 115189 - DNA, 999 bp, Homo sapiens
  Payload ID: 2495
  Gene Symbol: CCL15-CCL14
  Gene Name: CCL15-CCL14 readthrough (NMD candidate)
  ENST ID: ENST00000632206
  CDS Start-End: 130-471
ctgccctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 115190 - DNA, 2241 bp, Homo sapiens
  Payload ID: 2496
  Gene Symbol: CNOT1
  Gene Name: CCR4-NOT transcription complex, subunit 1
  ENST ID: ENST00000245138
  CDS Start-End: 93-1043
aggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagtccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccacccctaccctcacccccccaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacac

SEQ ID NO: 115191 - DNA, 8471 bp, Homo sapiens
  Payload ID: 2496
  Gene Symbol: CNOT1
  Gene Name: CCR4-NOT transcription complex, subunit 1
  Uniprot ID: A5YKK6
  ENST ID: ENST00000317147
  CDS Start-End: 334-7464
gaaatgggaacggggaggggaaaggccgcgacgtgagcgcgcgacctccggcgccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccacccctaccctcacccccccaatcctctcctgaaacttaaaaacagtgggaatataggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatgacacaca

SEQ ID NO: 115192 - DNA, 4999 bp, Homo sapiens
  Payload ID: 2496
  Gene Symbol: CNOT1
  Gene Name: CCR4-NOT transcription complex, subunit 1
  Uniprot ID: A5YKK6
  ENST ID: ENST00000441024
  CDS Start-End: 286-4941
cggcgccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtgtaagttggctatttccttggtataggtacaaaacgtattactgcttgtctgtaataatttttttctttgtctatatatggcactgggcgttaccacttattcttaataatcaccatatttgtttgatgtcttccatcattttagattgtaattctgtgaggcaaagcatcatgtctgtgtgtttttttttttttctgttatattctcaacacgatgtttgacagatagtagatacccaaatatttgttggtttaaataaattaagatttaaaaaggaaa

SEQ ID NO: 115193 - DNA, 831 bp, Homo sapiens
  Payload ID: 2496
  Gene Symbol: CNOT1
  Gene Name: CCR4-NOT transcription complex, subunit 1
  ENST ID: ENST00000569882
  CDS Start-End: 1-831
cgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgag

SEQ ID NO: 115194 - DNA, 1317 bp, Homo sapiens
  Payload ID: 2496
  Gene Symbol: CNOT1
  Gene Name: CCR4-NOT transcription complex, subunit 1
  ENST ID: ENST00000568917
  CDS Start-End: 1-1317
ccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacaggtagagcttttggaaagaaagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaag

SEQ ID NO: 115195 - DNA, 553 bp, Homo sapiens
  Payload ID: 2496
  Gene Symbol: CNOT1
  Gene Name: CCR4-NOT transcription complex, subunit 1
  ENST ID: ENST00000567133
  CDS Start-End: 1-553
agctgagctacatcaggagcatgacttaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgt

SEQ ID NO: 115196 - DNA, 385 bp, Homo sapiens
  Payload ID: 2496
  Gene Symbol: CNOT1
  Gene Name: CCR4-NOT transcription complex, subunit 1
  ENST ID: ENST00000565697
  CDS Start-End: 309-385
ttgctctgttgcccaggcttgagagcagtggtgtgatctcggctcactgcaacgtccgcctcccaggttcaagtgattctcctccctcagcctcccgagtagctgggattacaggcgcgtgccaccacggctgggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccg

SEQ ID NO: 115197 - DNA, 7660 bp, Homo sapiens
  Payload ID: 2496
  Gene Symbol: CNOT1
  Gene Name: CCR4-NOT transcription complex, subunit 1
  Uniprot ID: A5YKK6
  ENST ID: ENST00000569240
  CDS Start-End: 282-7397
gccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaa

SEQ ID NO: 115198 - DNA, 578 bp, Homo sapiens
  Payload ID: 2496
  Gene Symbol: CNOT1
  Gene Name: CCR4-NOT transcription complex, subunit 1
  ENST ID: ENST00000562046
  CDS Start-End: 1-578
tttcatcacagcttccagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagat

SEQ ID NO: 115199 - DNA, 7830 bp, Homo sapiens
  Payload ID: 2496
  Gene Symbol: CNOT1
  Gene Name: CCR4-NOT transcription complex, subunit 1
  Uniprot ID: A5YKK6
  ENST ID: ENST00000567188
  CDS Start-End: 280-6732
cattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaagtattgaagaatgtcgcaatataatcgtgcagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagacggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtgctcctgacctctgataaagctgcagccaatttctcagatcgttctttgctgaagaacttgggacattggctaggaatgatcacattagctaaaaacaaacccatcttacacactgacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaacaacttctactacaccagctaccaacaccacttgtacagccacggttccaccacagccacagtacagctaccacgacatcaatgtctattcccttgcgggcttggcaccacacattactctgaatccaacaattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaagttggtggtgtggacccaaagcagttggctgtttacgaagagtttgcacgcaatgttcctggcttcttacctacaaatgacttaagtcagcccacgggatttttagcccagcccatgaagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtgcctaattgaatgtcgagatgaatataaatataatgtggaggctgtggagctgctaattcgcaatcatttggttaatatgcagcagtatgatcttcacctagcgcagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaaggattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaagagtcttactctgtgacccaggctggagtgcagtggtgcagtctcggcttactgcaacctccccttcgctggttcaagctattctcccgcctcagcctcccaagtagctgggattacaggcactcgccaccacacctggctaattatgtgtttagtggagatggggtttcgccatgtcagccaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacat

SEQ ID NO: 115200 - DNA, 582 bp, Homo sapiens
  Payload ID: 2496
  Gene Symbol: CNOT1
  Gene Name: CCR4-NOT transcription complex, subunit 1
  ENST ID: ENST00000564557
  CDS Start-End: 395-582
tagagaaacaagcggagttaaccgaagagggggtcgaggagagccggagtcggggacccaggagtttcctgtgtccagcgctgccggagccgcctgagatggagtcttgctctgttgcccaggcttgagagcagtggtgtgatctcggctcactgcaacgtccgcctcccaggttcaagtgattctcctccctcagcctcccgagtagctgggattacaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaag

SEQ ID NO: 115201 - DNA, 567 bp, Homo sapiens
  Payload ID: 2496
  Gene Symbol: CNOT1
  Gene Name: CCR4-NOT transcription complex, subunit 1
  ENST ID: ENST00000566240
  CDS Start-End: 1-205
taagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtgaaggatgaaagctgtttgagaaggccgatacaaaatgacttaaagtgatgttgcatgtgcacacacttttcaaataattcacttactagttttgagtctcagatatcatggttaataattcagactgcttccccacaacaaagagaaatgatggatcaggcagctgctcaattagctcaggacaattgtgagttggcttgctgttttattcagaagactgcagtagaaaaagcaggccctgagatggacaagagattagcaactgaatttgagctgagaaaacatgctaggcaagaaggacgcagatactgtgatcctgttgttttaacatatcaagctgaacggatgccagagcaaatcaggctgaaag

SEQ ID NO: 115202 - DNA, 739 bp, Homo sapiens
  Payload ID: 2496
  Gene Symbol: CNOT1
  Gene Name: CCR4-NOT transcription complex, subunit 1
  ENST ID: ENST00000565605
  CDS Start-End: 280-570
cattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtg

SEQ ID NO: 115203 - DNA, 535 bp, Homo sapiens
  Payload ID: 2496
  Gene Symbol: CNOT1
  Gene Name: CCR4-NOT transcription complex, subunit 1
  ENST ID: ENST00000569020
  CDS Start-End: 461-535
aaatgggaacggggaggggaaaggccgcgacgtgagcgcgcgacctccggcgccattttgtagagaaacaagcggagttaaccgaagagggggtcgaggagagccggagtcggggacccaggagtttcctgtgtccagcgctgccggagccgcctgaggtgaccagcacccatgcagaaactacctagaagttgccaagctatcagtcaactcagcatacaaaaagaaacttaccattctaaggatcttagaagttgtatgccaggaaatgggatgaagaccaaatgtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattac

SEQ ID NO: 115204 - DNA, 722 bp, Homo sapiens
  Payload ID: 2496
  Gene Symbol: CNOT1
  Gene Name: CCR4-NOT transcription complex, subunit 1
  ENST ID: ENST00000567285
  CDS Start-End: 1-722
tatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagacttggatgtgaaatcattgctgctagaggcttatgttaaaggacaacaagaattgctctatgtagtgccctttgttgccaaagtcttagaatctagcattcgtagtgtggtttttaggccaccaaacccttggacaatggcaattatgaatgtattagctgagctacatcaggagcatgacttaaagttaaacttgaagtttgaaatcgaggttctctgca

SEQ ID NO: 115205 - DNA, 291 bp, Homo sapiens
  Payload ID: 2496
  Gene Symbol: CNOT1
  Gene Name: CCR4-NOT transcription complex, subunit 1
  ENST ID: ENST00000628857
  CDS Start-End: 1-291
atgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattgtctcgaatacttgatgtggcccaggacttga

SEQ ID NO: 115206 - DNA, 2573 bp, Homo sapiens
  Payload ID: 2497
  Gene Symbol: CNOT10
  Gene Name: CCR4-NOT transcription complex, subunit 10
  Uniprot ID: Q9H9A5
  ENST ID: ENST00000331889
  CDS Start-End: 317-2470
cacgccggcgctccaggcgcggcaggctgccgcccccggaagtagtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcaggtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaa

SEQ ID NO: 115207 - DNA, 2815 bp, Homo sapiens
  Payload ID: 2497
  Gene Symbol: CNOT10
  Gene Name: CCR4-NOT transcription complex, subunit 10
  Uniprot ID: Q9H9A5
  ENST ID: ENST00000328834
  CDS Start-End: 317-2551
cacgccggcgctccaggcgcggcaggctgccgcccccggaagtagtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacatttggccaaaagcttacttaaaattaaggatttactaagtcatcatcagctgtttttcttaatttcagccagactattaattttgagccattatgtaatatatgccataggcaattaaaacataattttatcagaa

SEQ ID NO: 115208 - DNA, 770 bp, Homo sapiens
  Payload ID: 2497
  Gene Symbol: CNOT10
  Gene Name: CCR4-NOT transcription complex, subunit 10
  ENST ID: ENST00000455381
  CDS Start-End: 1-132
ggattagatgatgttgaaaacagcatgttgtactataatcaagcagtcattctttatcatctgcggcagtatacagaagccatatcagttggtgaaaaactttatcagttcatagagccttttgactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataagggggtga

SEQ ID NO: 115209 - DNA, 687 bp, Homo sapiens
  Payload ID: 2497
  Gene Symbol: CNOT10
  Gene Name: CCR4-NOT transcription complex, subunit 10
  ENST ID: ENST00000430408
  CDS Start-End: 1-687
cctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaagctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggt

SEQ ID NO: 115210 - DNA, 2760 bp, Homo sapiens
  Payload ID: 2497
  Gene Symbol: CNOT10
  Gene Name: CCR4-NOT transcription complex, subunit 10
  Uniprot ID: Q9H9A5
  ENST ID: ENST00000454516
  CDS Start-End: 86-2500
agttaactgatgattttcagttttgaaaacgtggtgcatttcttttctgcttagttcaaacctaaaggcaattgtttatttagaaatgaagtctattggtgtaaagactgtcaaggtttgtgggtcaaagagctctgtacgcatagaaggtcagccatgttcattaggccagagtagaaggaaagtcaagcttatgggtgaacggtcgtatactctttcaattggcaacggagactacttttgggcaaataaagaaatgctgtgggattatgtgcagactctgtctgatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacatttggccaaaagcttacttaaaattaaggatttactaagtcatcatcagctgtttttcttaatttcagccagactattaattttgagccattatgtaatatatgccataggcaattaaaacataattttatc

SEQ ID NO: 115211 - DNA, 2290 bp, Homo sapiens
  Payload ID: 2497
  Gene Symbol: CNOT10
  Gene Name: CCR4-NOT transcription complex, subunit 10
  ENST ID: ENST00000435630
  CDS Start-End: 242-2071
gtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacagtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcaggtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcacagtggctcatgcctcccagcactttgggaggccgaggcaggcggatcatgaggtcaggagtttgagaccagcctggccaatatggtgaaaccccatctctactaaaaatacaaaaattagccaggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatactt

SEQ ID NO: 115212 - DNA, 2096 bp, Homo sapiens
  Payload ID: 2497
  Gene Symbol: CNOT10
  Gene Name: CCR4-NOT transcription complex, subunit 10
  ENST ID: ENST00000416457
  CDS Start-End: 1-632
attatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaatgtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaa

SEQ ID NO: 115213 - DNA, 2599 bp, Homo sapiens
  Payload ID: 2498
  Gene Symbol: CNOT11
  Gene Name: CCR4-NOT transcription complex, subunit 11
  Uniprot ID: Q9UKZ1
  ENST ID: ENST00000289382
  CDS Start-End: 164-1696
cctcgctttcgctgggcgctgtccctctccgcggcggtctggtttccccgacgtgttttgtttgcgacgctgtcgtgtaacagcgcgctttacggccgcggggacggagcgagccggcgccagggcccctcgggccgggaagaggggaaggggagcgaggttgatgcccggcggaggggcgagcgcggcgtctggccggcttctcaccgccgcggagcaaagagggtcccgggaagcggcagggtcggcgtccaggagcggcttcgggggctccggcggcggcagaggcggagcaagcggccccgggtccgggagcggaggcccggggggccccgcgggcaggatgagcttgaccccgaaggagctctcgagcctgctgagcatcatatcggaggaggcgggcggcggcagcaccttcgagggcctgtccaccgccttccaccactacttcagcaaggccgaccacttccgcctgggctcggtgctcgtcatgctgctccagcagcccgacctgctgcctagcgcggcgcagcgcctcacggcgctctacctgctctgggagatgtaccgcaccgagccgctggccgccaaccccttcgccgccagcttcgcgcacctgctcaaccccgcgccgcccgcccgcggcggccaggaacccgaccgccctccgctctcaggatttttacctcctataactccaccagaaaagttttttctttcccagctgatgctggcacccccacgggaactcttcaaaaagacgcctcgccagattgcactgatggacgttggaaacatgggccagtctgtggacattagtgggcttcagttagccttggccgaacgccaatctgaattgccaacgcaaagcaaagcgagcttccccagtattctcagtgacccagacccggattcttctaattctggatttgacagctcagttgcctctcagatcacagaagctttagtcagcggaccaaagccacctattgaaagccattttcgaccagagtttattcgtccaccgcctccactccacatttgtgaggatgaacttgcttggctaaaccccacggagcctgaccacgcgatccagtgggataaatcgatgtgtgttaagaatagcactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcagaatcggttggtgcgtcttgtgtgtgtgtttctccaatccttgatccgtaacaaaattattaatgtacaggatttgtttatagaagtgcaggcattctgtattgaattcagtaggatacgagaagctgctggtcttttccggttgttgaagacattggatactggggaaacaccttctgagaccaaaatgtcaaaataatacctcatcagaaccatcccatccattcactgttcagctgtactgtgatttagtttttacaccgttaaaaccctgagtggattgcttggtttaatgcatataaacagtactttatctacttaaagcaaagttttgctttcttgaatgactttttctgtgagatgaatttttgataagaactagggaaaacatgtcttttaggtgtcttgctgatgactatccataggaggaatggctatcccaaaaaaagttccgcaaaaaagtagatgagtttcttttttttttaagcactaaagaacaaaatgcatttttcattaatacaggcttctgatgaaccaggaatcctgttttcgtaaagttccaatgttgatgagagtaaattcttaagcatttgtcctagaggtgaaagcagctgaatgtttctgaaccatcaagaggcaaacaaacaggagtttgtttcttgaacctgcttatgcacacagctcttaactcctcatgaggcacacagctcttaactcctgatgaaccaaggatttactcataactttctccttgtcatggaggcttaatagacaacagaataaatgcatttcttgggcctcttataaacttgggaattcttagaaagctgcttctattaccaggctgtaatagctggtatagttttttttttttctcttaagatgttctgttattagtctgagacagccatttttttgttttaaggaaaaatatcagtcagtgctccgggaggtaatttcctgtggggtctgcaccctcctgtctgggtggtggatgtgggtttgagaagtaggagagcagggtggtaccgtgtgggctcttaccctttatgtgattttggacaacagtgccttccattaaagttctttttatcaactgtta

SEQ ID NO: 115214 - DNA, 552 bp, Homo sapiens
  Payload ID: 2498
  Gene Symbol: CNOT11
  Gene Name: CCR4-NOT transcription complex, subunit 11
  ENST ID: ENST00000420107
  CDS Start-End: 1-382
cactggtgtggagatcaaacgaataatggccaaagccttcaaaagccccttatcctctccccaacaaacacagctacttggtgagttggaaaaagaccccaaacttgtctaccatattggcctcaccccagccaaacttcctgaccttgtggaaaacaaccctttagtcgctatagaaatgttgctgaaattaatgcagtcaagccagatcactgagtatttctctgtcctggtcaatatggacatgtctttacattcaatggaagttgtaaatcgactaactacagctgttgatctacctcctgaatttattcacctttatatatcaaattgcatctctacttgtgaacagattaaggataaatatatgcaggtaatataaatttttgtaaattttataaatggctgccaggaaaatgagcagactaacatttttttttttcctttttcagaatcggttggtgcgtcttgtgtgtgtgtttctccaatccttgatccgtaacaaaattattaatgtacaggatttgtttatagaagtgcaggcattctgta

SEQ ID NO: 115215 - DNA, 3282 bp, Homo sapiens
  Payload ID: 2499
  Gene Symbol: CNOT2
  Gene Name: CCR4-NOT transcription complex, subunit 2
  Uniprot ID: Q9NZN8
  ENST ID: ENST00000229195
  CDS Start-End: 583-2205
acaaacacaaacacaaacacgaacacgaacacgctcagcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctc

SEQ ID NO: 115216 - DNA, 3152 bp, Homo sapiens
  Payload ID: 2499
  Gene Symbol: CNOT2
  Gene Name: CCR4-NOT transcription complex, subunit 2
  Uniprot ID: Q9NZN8
  ENST ID: ENST00000418359
  CDS Start-End: 452-2074
agcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcgtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaagacttcccttttcttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctttgtaataaagtagaaaagctctcctca

SEQ ID NO: 115217 - DNA, 2360 bp, Homo sapiens
  Payload ID: 2499
  Gene Symbol: CNOT2
  Gene Name: CCR4-NOT transcription complex, subunit 2
  ENST ID: ENST00000552599
  CDS Start-End: 1-559
tccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctgtatgttcaaagtattttaatcacttttgtattatagtggatcttgactatgctgaaaacatctttaagtgatgatggctatctttaaatggaactatttctccatcaagaaatttatttttacattattaaagtgaatttaatttagattaaaaccgtatcttaaccatggcttcataatctatatacctaaaaagaatttcaaacttaatgctgaagctgggtgcagtggctcacacttgtaatcccagcactttggtgaggtggacagatcacttgaggccagaagttagggacagcctgggcaacacagcaaaccacatttctacaaaaaataaaggaaaatattagctaggtgtggtggcacacatctatatagtcctagctacttgggaggctacagcaggaggatcgcttgagcccaggagtttgaggtgtcagtgagctatgattgtgccattgcactctagtgtggctgacagtgcaagaccctgtctctaaaaataactaataagtgccaaatttgtaagaagacagaattgacataactcatggatttggtgaatctaatttttgtaaatatgtgaattatatgatattcatgactatgttttttattccttgtggaaccatatgtataaataattcgatactgaatttaatcatttcataaacattattacttataagcaaggcagtgtgcatatttgttgtacgttttgaagtgctgattaaagtccacattttcattatcagcagtctattggccagtttaaacaaatattaatgtaaagaaattggttcattgatattttttccctgagcagttctgtatttacctgatgctctaaaattaagttttctgtcgttactcaaatgtacagttggcaacacattttgttatcaatagacaattatgtttactatagagtaaactattagtaattatttatgaccttatgattgggagaccttttcacaaatttaagtatttcataacatttctaataacatttctataaatggctttggatcaaatagtttaaagtatataattcagtatgttgataatgaattgtttcgtttcatttcacaactgagaggatttttcccttatgtttttccttcatttttgtgagaatagagattattacctgttgttccttttaattgttcataagtaaataaatacattcaggcactcattcatctatcactggcagttctgttttcatattttatttatgtcttaaaaactacctcatgacgttggtaggaaagcatttctttacatggaggtttattttgtgggacattacctcctctggatgttacttcctcagtttacaagtagtgtaaattctcattgattcttttatgaattgtaatggattttctcttagcttttgagaatttagaatctgaaatttgaataaaaagtaaatatattcagtataatttttcaaaatgctctagtttcaagatagttaaaaaattatgtggaatttacataattaattcaaatatagtttgtatttagttccttatcaaataatgcaaatagttggagatacctcaatttcttttgagtgttaagaagagcaagaaaggagtgaagtttttgcaacacattgtgtctttatttggtctgcctatgtttttatcacattgcttataaaacttttaaaatccttgtttgtataaaaagtttctttagttaaataaaagtgtgtgtattaattagtgtgccttctggacaaattaagaaatattttttctatatttcaatgcggttgtatttaataacttataataaatgagtaggaagcattcatatt

SEQ ID NO: 115218 - DNA, 1071 bp, Homo sapiens
  Payload ID: 2499
  Gene Symbol: CNOT2
  Gene Name: CCR4-NOT transcription complex, subunit 2
  ENST ID: ENST00000552915
  CDS Start-End: 144-1071
ggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacc

SEQ ID NO: 115219 - DNA, 587 bp, Homo sapiens
  Payload ID: 2499
  Gene Symbol: CNOT2
  Gene Name: CCR4-NOT transcription complex, subunit 2
  ENST ID: ENST00000551710
  CDS Start-End: 1-315
ccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggtatatttctttccatgtgcaaatgtataaatctaaacttgaaaaaagaagtgtcctcttttatctgtttataagtaccaatacatccagttccagtaatgtgccacatatttgccaactgtttaattccatctccttggcttgacactcttagaagagtgtcccaaaacaattggtttcactgatagttacattattgaatttggtaagaggttttgtaattttgcataagccttggtaacatttgaaatattttttgtgtctactgctttgtaaaataaagatactctcttgcaacccca

SEQ ID NO: 115220 - DNA, 464 bp, Homo sapiens
  Payload ID: 2499
  Gene Symbol: CNOT2
  Gene Name: CCR4-NOT transcription complex, subunit 2
  ENST ID: ENST00000549709
  CDS Start-End: 1-139
tctctaccccaaatttgcgtcaccctgggcatcttcaccttgtcgacctcaagacatagacttccatgttccatctgagtacttaacgaacattcacattagggataagttatttttctttttcagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaa

SEQ ID NO: 115221 - DNA, 964 bp, Homo sapiens
  Payload ID: 2499
  Gene Symbol: CNOT2
  Gene Name: CCR4-NOT transcription complex, subunit 2
  ENST ID: ENST00000550641
  CDS Start-End: 376-964
atcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagtaaagacggggtttcaccgtgttagccaggatggtctcgatctcctgacttcatgatccgcctgccttggcctcccaaagtgcttggattacaggcgtgagccaccgcacctggccgcaaagttatcttttaagaggttatcttaggtcttgcgtggagtctaggatgatagcactgatggtggcaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacag

SEQ ID NO: 115222 - DNA, 536 bp, Homo sapiens
  Payload ID: 2499
  Gene Symbol: CNOT2
  Gene Name: CCR4-NOT transcription complex, subunit 2
  ENST ID: ENST00000548741
  CDS Start-End: 139-249
atacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggctttggtatcaggatgatgctggcctcataaaatgaattagggaggattccctctttttctatttattggaatagtttcagaaggaatggtaccagctcctccttgtacctctggtagaattcgg

SEQ ID NO: 115223 - DNA, 726 bp, Homo sapiens
  Payload ID: 2499
  Gene Symbol: CNOT2
  Gene Name: CCR4-NOT transcription complex, subunit 2
  ENST ID: ENST00000546673
  CDS Start-End: 1-548
gtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctgtatgttcaaattttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaaa

SEQ ID NO: 115224 - DNA, 783 bp, Homo sapiens
  Payload ID: 2499
  Gene Symbol: CNOT2
  Gene Name: CCR4-NOT transcription complex, subunit 2
  ENST ID: ENST00000552319
  CDS Start-End: 167-331
gtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagcctccagctctgagctttccaatccccagagtagcaaatgttgaaagaagttgcacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagcctttta

SEQ ID NO: 115225 - DNA, 993 bp, Homo sapiens
  Payload ID: 2499
  Gene Symbol: CNOT2
  Gene Name: CCR4-NOT transcription complex, subunit 2
  ENST ID: ENST00000550160
  CDS Start-End: 165-993
cttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaaacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatag

SEQ ID NO: 115226 - DNA, 571 bp, Homo sapiens
  Payload ID: 2499
  Gene Symbol: CNOT2
  Gene Name: CCR4-NOT transcription complex, subunit 2
  ENST ID: ENST00000547867
  CDS Start-End: 368-571
agggagacgtggtgggcggtccttcctgtgacacgacccttgagtgacagttctatttgattgcctccggtactgtgaggaaaggacacgactctatggtgaggactgatggacatacattatctgagaaaagaaactaccagtaaagacggggtttcaccgtgttagccaggatggtctcgatctcctgacttcatgatccgcctgccttggcctcccaaagtgcttggattacaggcgtgagccaccgcacctggccgcaaagttatcttttaagaggttatcttaggtcttgcgtggagtctaggatgatagcactgatggtggcagcctccagctctgagctttccaatccccagagtagcaaatgttgaaagaagttgcacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacggg

SEQ ID NO: 115227 - DNA, 355 bp, Homo sapiens
  Payload ID: 2499
  Gene Symbol: CNOT2
  Gene Name: CCR4-NOT transcription complex, subunit 2
  ENST ID: ENST00000548338
  CDS Start-End: 1-298
acatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctgagttccatctggaatatgacaaattagaagaacggcctcacctgccatccaccttcaactacaaccctgctcagcaagccttct

SEQ ID NO: 115228 - DNA, 4753 bp, Homo sapiens
  Payload ID: 2499
  Gene Symbol: CNOT2
  Gene Name: CCR4-NOT transcription complex, subunit 2
  Uniprot ID: Q9NZN8
  ENST ID: ENST00000551483
  CDS Start-End: 4156-4731
gtcaacaaagtaatcttgagataacagttactgtttgagattcttacagttgtgaaatttggagaaaactaaaaattaattgggaagtggcaaaataaattgaaaatggtaaaacaaaaattaaaagctatagcgcaggctaaaaggacggtagaaagttttcttcaaaaattaagaacccaaggttataagaatactaaaaagttaagaaattgagatgattaaaatagacaaagtagagaagttgggttaaattttaatttttaaaggaagccagctgattgttttaacttaaaatgaacaaaaatacatttaatttattctatatatatttattgagcgcctactgtgtaataggtaatataaacttctgggctttgtatcatatttctatatttcctatccatttaccatatatgggaaccctactgccaccctgttgtaccccaccctcaaaatgcgcacatgcgcacgcacacacgtttgtatatgaaagcggtcaattacaggtggaagtcctcagggcttctgcttcactgcctgtgcctcagctatatctttctggccatttgcaggaggcactatcattgtcaccatttgtgtgtaaccgaagcttcaagcattctagatataacctccatctgagcataatgaaaagacaagttatatcgtaacaatctccctcttgttagctcacaagctataattttaggttaccatcttccatgggggaaatatatgctttttattctctttgttacatctctaggatttggggtttctattatgctggttgcgtattcctttgctaaattgttcatggaattctttgacatgaaatcaatctgcaagtatcttttgagcacctacatacacctagtacagtgccgtgcattatttaggaagaaggcgcaatcatttcgaattatattatggttggtttttataatctcttaaaaaatatttgtagaatcaataaccagtgtcctttcttattatttagacggaagtgaaaatgtgacaggattggacctttcagatttcccagcattagcagaccgaaacaggagggaaggaagtggtaacccaactccattaataaaccccttggctggaagagctccttatggtaattaagctttttaatgatggccagtagaaagtttccattgtatgtgcacacacatatacatttacatgtacgtatacatatgcttgtgtgtgtacacatgtatgtttgcattttctaatcaggttagtgtaattttttcagaattgatatattagaagtgatttttcttcccagaataccatgatagcaaagttaaatgggaaaactttgtacaaaaacccaagaggaagtcctcattggtattcagaagttattttcttctgttatccctgccttagtttaccttaagtgttttattttgtggtctgccttttctctccttaattgatcacacattttttcaaaataatatattcctggtgattaataatgactgactatacattgaagatgtttttctgagccaaggtttttctcaacctccacactgttgacatttgggccaggtaattctttgtagagaggagatgtggggggctattgtgtttatacagaatgttaagcaatattcctggccttggcctacaagatgctagtagcactttctgtttctaacccccatagcctctattgtgacagacacaaatgttttcagacattggcagatgtcacctggggaaaaaaaattgccccctgttgaaaaccattgctcatgggtcatgtatagcttatgcagactcttggtctccgttaatatccttcatcaccctttttcactgtctctaatagataagaaatttggctaatcagggataaatggaaataaaggaggggaaacatatgcaataacaatataacaatgtagatatgaaaattctgtgacagcaatgtagctatactatttttatcacatagtttttttcttttgggaaaacctgatagagaccagtaacaaaacggtgaatttaaaagaatcagttcatccattattttaagatagaattaatatttgatcacattttcaaccaagaaggatttctgtgccattcagatatgaatacaaataacagtatatgaagaagggaaacatttattgtttatattctaaagtttccaaattagtctccccaaaataaaaaaaaaaatgatctgccctggaagttgagtacctagctacttgattctcagttcagactctaatgtttttaacctttcctcataggtccattttttcatccctttaatcattcccgttgctctccttggaccatctctagtttctccatatcgttcttgaattgtggagccccaaactggatattgttctccaataagggcccgactaatgccaagtatagtgggaggattatttcccagttcttgcatgttttacatctataacatggagtccaagaaaatctgaaataatatggagttgttttataattgattgcaatttgctcactctgtaagtcgctttcaagtagaatactgacatattcttttaaattttattttgttcatttgtatttgagagttaactggtatttataatatctagtcaaatatttaaataaaacaagcttttaaaccaaaattgttaataattaatccaatatcaaattaaatttttaagcacctacgcatgacatggattactgttgatttcccttgtattattttgtatgttgagttattaatcagtaaatgaaaatttagttcttcattgttaccctggatactaattttttgaagtacgctttcatagcattaaaaaaaagaaaccttttggtgtattatcatgaggaaagttaactttataatctgtagcaaaatatcataaatatcaattgcaattctccggattattttcattacatagttggaatggtaacaaaaccagcaaatgaacaatcccaggacttctcaatacacaatgaagattttccagcattaccaggctccagctataaagatccaacatcaagtaatgatgacagtaaatctgtaagtaactgagaagtgtgtatgtgagtgatgtagtttttcccttcagatttctcttatattaacaattacttactaaatactattacaaaactgttttatcttgatatctgtaataacctaacttctgaagaatgtggaaaagctttataacttagaagatagcctatttttttcctatttcatataggtttgcaaatttctgttgaacttctcagagttaatttagacttttattgtagtccctgtcagctggatcccatgaagtttgataatatagccttctaaggagctgtgtttttcttgagtaagttttctccttgaagaatttatacacatttttatacctgtgttgattcaaccaactcagcttcttctttctgacttaacaaatatgtttatttcttccacatttcactgaaaatagcttttctctgtgtgtgatgggagtttatatattattaaaataattgataaagaagatcggtaagaattaaaataagtacaaagttttaaagcttgtatgtctaacttatcttcaaggtagctttggtgattttaggtaatatactatatttagtttctcttttacatgaaagcattgaggagtgtaacttcaagtgtatcccaaagcataaagacctgagaaagagatagatttttttttttctgtgactgaagatctgagataaataagatattttcccttgatttctttttctttaaatactcaaatgtggatgatataggatttatttgtataccatggaacaatgatggaaacaattttctatagaacttgaaaaacaggtaataatttaactaccaatttaaatgtaataaagaataaatagcaaggtattaatatgtgaacttgaatttgtatacttaacaaattttaatgtcacatttaatttttttcatgctagaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttctaaaaaaaaaaaaaaaaaaaaaaaa

SEQ ID NO: 115229 - DNA, 576 bp, Homo sapiens
  Payload ID: 2499
  Gene Symbol: CNOT2
  Gene Name: CCR4-NOT transcription complex, subunit 2
  ENST ID: ENST00000553020
  CDS Start-End: 128-238
tcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagttta

SEQ ID NO: 115230 - DNA, 2288 bp, Homo sapiens
  Payload ID: 2499
  Gene Symbol: CNOT2
  Gene Name: CCR4-NOT transcription complex, subunit 2
  Uniprot ID: Q9NZN8
  ENST ID: ENST00000551043
  CDS Start-End: 668-2288
gctgtactcgggccgctgcagcagcagcagctccagatcctaggcccggtcccatccgcgagtggtggggcttccccagactccactcccctaggctcccgccagcgcggaggagccgctgccgccgcgctgcttcctgggggagaagagaaggcggcagcggccgtggccgtggccgacgagctcgagcccgctttagacggctctgccgccttcccggcagctggtgctgtctgtggcttcttaccttctctcaatacacgtatatcatctgccagttatgtgtatttctgttagtgtgtttgcaagtgtcagatgggagacactggactggctaacgggtgtcaggatcctgcaggccctgggataccgaaggctgtgcatggtggagggagaaggaatgcaactgcgatgccgcctctgccaccgcaccaggaaggtgaagcttccgtagtgtcgtagactgagtccggatgatcctggggcggcggaggaaccacagacgcttctgtctgtgaagttgcaagtcctgggtttctacttccgcaggggcctctccaccttttgctgtcagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttct

SEQ ID NO: 115231 - DNA, 571 bp, Homo sapiens
  Payload ID: 2499
  Gene Symbol: CNOT2
  Gene Name: CCR4-NOT transcription complex, subunit 2
  ENST ID: ENST00000551661
  CDS Start-End: 156-386
agcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagcctccagctctgagctttccaatccccagagtagcaaatgttgaaagaagttgcacagacgtggtctcactctgtcacccaggctggactgcagtggcgtcatcttggctcactgcaacctccgcctcccaagttcaagtgattctcctgcctcggcctccaagtagctgggactacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaa

SEQ ID NO: 115232 - DNA, 747 bp, Homo sapiens
  Payload ID: 2499
  Gene Symbol: CNOT2
  Gene Name: CCR4-NOT transcription complex, subunit 2
  ENST ID: ENST00000550194
  CDS Start-End: 96-747
agggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacaggaatcaggcatttggaatgaataactccttatcaagtaacatttttaatggaacagacggaagtgaaaatgtgacaggattgg

SEQ ID NO: 115233 - DNA, 1085 bp, Homo sapiens
  Payload ID: 2499
  Gene Symbol: CNOT2
  Gene Name: CCR4-NOT transcription complex, subunit 2
  ENST ID: ENST00000549750
  CDS Start-End: 538-1085
gtcgctgtactcgggccgctgcagcagcagcagctccagatcctaggcccggtcccatccgcgagtggtggggcttccccagactccactcccctaggctcccgccagcgcggaggagccgctgccgccgcgctgcttcctgggggagaagagaaggcggcagcggccgtggccgtggccgacgagctcgagcccgctttagacggctctgccgccttcccggcagctggtgctgtctgtggcttcttaccttctctcaatacacgtatatcatctgccagttatgtgtatttctgttagtgtgtttgcaagtgtcagatgggagacactggactggctaacgggtgtcaggatcctgcaggccctgggataccgaaggctgtgcatggtggagggagaaggaatgcaactgcgatgccgcctctgccaccgcaccaggaagagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcg

SEQ ID NO: 115234 - DNA, 2549 bp, Homo sapiens
  Payload ID: 2499
  Gene Symbol: CNOT2
  Gene Name: CCR4-NOT transcription complex, subunit 2
  ENST ID: ENST00000548159
  CDS Start-End: 956-2549
gtgtatgggggtggtggtggaccggacgtaaagcgtcgctgtactcgggccgctgcagcagcagcagctccagatcctaggcccggtcccatccgcgagtggtggggcttccccagactccactcccctaggctcccgccagcgcggaggagccgctgccgccgcgctgcttcctgggggagaagagaaggcggcagcggccgtggccgtggccgacgagctcgagcccgctttagacggctctgccgccttcccggcagctggtgctgtctgtggcttcttaccttctctcaatacacgtatatcatctgccagttatgtgtatttctgttagtgtgtttgcaagtgtcagatgggagacactggactggctaacgggtgtcaggatcctgcaggccctgggataccgaaggctgtgcatggtggagggagaaggaatgcaactgcgatgccgcctctgccaccgcaccaggaaggtgaagcttccgtagtgtcgtagactgagtccggatgatcctggggcggcggaggaaccacagacgcttctgtctgtgaagttgcaagtcctgggtttctacttccgcaggggcctctccaccttttgctgtcagggagacgtggtgggcggtccttcctgtgacacgacccttgagtgacagttctatttgattgcctccggtactgtgaggaaaggacacgactctatggtgaggactgatggacatacattatctgagaaaagaaactaccagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtcgggttactaacattcctcaagggatggtgacggaccaatttggaatgattggcctgttaacatttatcagggcagcagagacagacccaggaatggtacatcttgcattaggaagtgacttaacaacattaggcctcaatctgaactctcctgaaaatctctaccccaaatttgcgtcaccctgggcatcttcaccttgtcgacctcaagacatagacttccatgttccatctgagtacttaacgaacattcacattagggataagctggctgcaataaaacttggccgatatggtgaagaccttctcttctatctctattacatgaatggaggagacgtattacaacttttagctgcagtggagctttttaaccgtgattggagataccacaaagaagaacgagtatggattaccagggcaccaggcatggagccaacaatgaaaaccaatacctatgagaggggaacatattacttctttgactgtcttaactggaggaaagtagctaaggagttccatctggaatatgacaaattagaagaacggcctcacctgccatccaccttcaactacaaccctgctcagcaagccttct

SEQ ID NO: 115235 - DNA, 618 bp, Homo sapiens
  Payload ID: 2499
  Gene Symbol: CNOT2
  Gene Name: CCR4-NOT transcription complex, subunit 2
  ENST ID: ENST00000551132
  CDS Start-End: 374-618
agcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggctttggtatcaggatgatgctggcctcataaaatgaattagggaggattccctctttttctatttattggaatagtttcagaaggaatggtaccagctcctccttgtacctctggtagaattcggctgtgaatccatctggtcctggatttttttggttggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcaca

SEQ ID NO: 115236 - DNA, 643 bp, Homo sapiens
  Payload ID: 2499
  Gene Symbol: CNOT2
  Gene Name: CCR4-NOT transcription complex, subunit 2
  ENST ID: ENST00000548599
  CDS Start-End: 96-284
agggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaaagttcaacaacacaaaataataaccagcagaaaaaagggatccaggtgttacctgatggtggg

SEQ ID NO: 115237 - DNA, 895 bp, Homo sapiens
  Payload ID: 2499
  Gene Symbol: CNOT2
  Gene Name: CCR4-NOT transcription complex, subunit 2
  ENST ID: ENST00000552483
  CDS Start-End: 463-895
gtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccagagacagggtctcactatgttgcccaggcttgtcaagtgatcctcccacctcagcctctcaagatgctgggattacagagcggaagaatcccatcgtttatcatgttctggttggactttcttactgtttgctggagttgaacttcagagctatggcgtcaaccctgctgtaatatctcaggggagctcctagggtggggctggtgccatggctcaccctccaacctttccttcttcacttcagcctccagctctgagctttccaatccccagagtagcaaatgttgaaagaagttgcacaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaaacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatc

SEQ ID NO: 115238 - DNA, 677 bp, Homo sapiens
  Payload ID: 2499
  Gene Symbol: CNOT2
  Gene Name: CCR4-NOT transcription complex, subunit 2
  ENST ID: ENST00000551873
  CDS Start-End: 284-677
agggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatgtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacag

SEQ ID NO: 115239 - DNA, 582 bp, Homo sapiens
  Payload ID: 2499
  Gene Symbol: CNOT2
  Gene Name: CCR4-NOT transcription complex, subunit 2
  ENST ID: ENST00000547780
  CDS Start-End: 506-582
aaacacaaacacgaacacgaacacgctcagcgtccccggggagggcggactgaagccacctcaccattcatcgcccctggaccccgcagtccccctcggactcagggccagagccttctgagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaag

SEQ ID NO: 115240 - DNA, 1545 bp, Homo sapiens
  Payload ID: 2499
  Gene Symbol: CNOT2
  Gene Name: CCR4-NOT transcription complex, subunit 2
  ENST ID: ENST00000552231
  CDS Start-End: 583-1545
acaaacacaaacacaaacacgaacacgaacacgctcagcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcgagggagacgtggtgggcggtccttcctgtgacacgacccttgagtgacagttctatttgattgcctccggtactgtgaggaaaggacacgactctatggtgaggactgatggacatacattatctgagaaaagaaactaccaggtgacaaacagcatgtttggtgcttcaagaaagaagtttgtagagggggtcgacagtgactaccatgacgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacagtatgtctggatttggaatgaacaggaatcaggcatttggaatgaataactccttatcaagtaacatttttaatggaacagacggaagtgaaaatgtgacaggattggacctttcagatttcccagcattagcagaccgaaacaggagggaaggaagtggtaacccaactccattaataaaccccttggctggaagagctccttatgttggaatggtaacaaaaccagcaaatgaacaatcccaggacttctcaatacacaatgaagattttccagcattaccaggctccagctataaagatccaacatcaagtaatgatgacagtaaatctaatttgaatacatctggcaagacaacttcaagtacagatggacccaaattccctggagataaa

SEQ ID NO: 115241 - DNA, 1682 bp, Homo sapiens
  Payload ID: 2499
  Gene Symbol: CNOT2
  Gene Name: CCR4-NOT transcription complex, subunit 2
  ENST ID: ENST00000552151
  CDS Start-End: 1-457
cgaaaacatgtactacagccagtcttctatgtttccacatcggtcagaaaaagatatgctggcatcaccatctacatcaggtcagctgtctcagtttggggcaagtttatacgggcaacaaagtgcactaggccttccaatgagggggatgagcaacaatacccctcagttaaatcgcagcttatcacaaggcactcagttaccgagccacgtcacgccaacaacaggggtaccaacaatgtcacttcacacgcctccatctccaagcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacaggtaagatgtttattgatactgtgtataattgtctttctgggtatactcagatttgccttttcatattttcactttgttcttgaggtgtggcttctctctaataagtgtgtttcatcatgcatttatgtccaaagattctgttacccatcacaaaacgatacgttttcttgaaaatcaggttgattttggaaagcacattaaaacattttgttgttgtggttgttagaaaaggattgttcttggattcgccaccaggcaaattttggttgatatgtcctctctttataaaataagttgattacctgtgtggtaagagttctaggtttatgaatagaactggagacatgtttgactattactactttgctttagttatactttgagtaccttctcaagtaagatttggttttgtgcattggagacttaccaacaaaagactttttaagatcacatctatagtatttgaaaaccgtatcatgtttagggattcaaaacaaaaaaacgggtttttgtactttttcacttctctttgtactgtctgttgcatatactttgcgaataagaggagttactcattttgttaggattttcaagctgtttgggtaatttgtatgagaattatgtctgaaatataacactttcttgcaaaagtagtatttaagcttgattgcctacatgtatatatatgtattttttaaatggagaaatgtaggggcaaaactaccttgatctagttgttatcatcatacctgtttgattcactttattctgtctagtaaaatctgaattaaaataggtttagcacatttactgtttaatcctcattccataaactccaggttttgcttttatttagatatctataattttactgctcttttaaattttaaaaaacttatttgtgaagggttatcaaaattctcatctccttgatacctttctaaccttatatctttatcataactttatcatatctttgtgcgttctcatagtattgggcattgaatgtataaatttttacctttccatagtttttcacattttgtttttaaaatacactttgcttaaattgtcaatgtaacatggatctctaaaaccctgcttatttctactattgacagattgtatttattataaattgttttcatctctgagcacttattccatgtttgatggtacctgtaatagcatcagcaattctaatatgctattaaacaaaaatttccatt

SEQ ID NO: 115242 - DNA, 2852 bp, Homo sapiens
  Payload ID: 2500
  Gene Symbol: CNOT3
  Gene Name: CCR4-NOT transcription complex, subunit 3
  Uniprot ID: O75175
  ENST ID: ENST00000221232
  CDS Start-End: 317-2578
gaagagaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 115243 - DNA, 4118 bp, Homo sapiens
  Payload ID: 2500
  Gene Symbol: CNOT3
  Gene Name: CCR4-NOT transcription complex, subunit 3
  Uniprot ID: O75175
  ENST ID: ENST00000358389
  CDS Start-End: 1584-3845
aaattctccctgggggtaaggtaccagccctgtcctttgtgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccgtgagtgcagatcggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttacacacacacacacacacgcccttctctgtgagctgccagtttcatttgtctcctgacttgtctgagggatgacctctcctagccacctctgcccagcccctctgagtaggaagtgtgatctccagggctaatgcctccatcccagtcatcagctgtgtgcagcatgactgtcctgctctgaaaaacctttttgagtgtattctggggagaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatg

SEQ ID NO: 115244 - DNA, 1125 bp, Homo sapiens
  Payload ID: 2500
  Gene Symbol: CNOT3
  Gene Name: CCR4-NOT transcription complex, subunit 3
  ENST ID: ENST00000440571
  CDS Start-End: 1-1125
accgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggatcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccagg

SEQ ID NO: 115245 - DNA, 1269 bp, Homo sapiens
  Payload ID: 2500
  Gene Symbol: CNOT3
  Gene Name: CCR4-NOT transcription complex, subunit 3
  ENST ID: ENST00000457463
  CDS Start-End: 1-865
gaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcctggggtgtgggattttcccagtatgtgtccctgcaccaggctgtgggctctgctgccgagggaccttgatggcccccacttcacctccaggtcccagcactcagcagggcaggggctcagtgcggaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagaccacctacctaatgca

SEQ ID NO: 115246 - DNA, 2765 bp, Homo sapiens
  Payload ID: 2500
  Gene Symbol: CNOT3
  Gene Name: CCR4-NOT transcription complex, subunit 3
  ENST ID: ENST00000447684
  CDS Start-End: 343-2058
gcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggatgaggggccaagcaggtgctctgcagcccctgagcctggccctgggctcgccagcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagcccagagatgttagaactgcttgggttgacagcgaggctggtccactgaggcacacctcagccccgcttccagttgcccactggctcacccgcggcccctccccagccctgctccagcagccccagtctaggccgaccccactctgctcattggcacattctcaggcctccctggagaccactggggagctgtccagccccctcccaaccccacttctctgaaagcaattttcacctcctgtctcattttccttctcctgatcagcattggtatgttctgtgcccccagccccatctccaagaggattgtccagcccaactgtggtctgtggcgggggccggggttcagccctgatgtcctgccccattcccctggctccccacccagtttgggggccccctgatccccctctccactgttcctcccccagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatg

SEQ ID NO: 115247 - DNA, 541 bp, Homo sapiens
  Payload ID: 2500
  Gene Symbol: CNOT3
  Gene Name: CCR4-NOT transcription complex, subunit 3
  ENST ID: ENST00000471126
  CDS Start-End: 1-267
gcacagtatctggcagccaaggccctaaagaagcagtcatggcgattccacaccaagtacatgatgtggttccagaggcacgaggagcccaagaccatcactgacgagtttgagcagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 115248 - DNA, 2765 bp, Homo sapiens
  Payload ID: 2500
  Gene Symbol: CNOT3
  Gene Name: CCR4-NOT transcription complex, subunit 3
  Uniprot ID: O75175
  ENST ID: ENST00000616102
  CDS Start-End: 343-2058
gcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggatgaggggccaagcaggtgctctgcagcccctgagcctggccctgggctcgccagcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagcccagagatgttagaactgcttgggttgacagcgaggctggtccactgaggcacacctcagccccgcttccagttgcccactggctcacccgcggcccctccccagccctgctccagcagccccagtctaggccgaccccactctgctcatcggcacattctcaggcctccctggagaccactggggagctgtccagccccctcccaaccccacttctctgaaagcaattttcacctcctgtctcattttccttctcctgatcagcattggtatgttctgtgcccccagccccatctccaagaggattgtccagcccaactgtggtctgtggcgggggccggggttcagccctgatgtcctgccccattcccctggctccccacccagtttgggggccccctgatccccctctccactgttcctcccccagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatg

SEQ ID NO: 115249 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  ENST ID: ENST00000619347
  CDS Start-End: 343-2058

SEQ ID NO: 115250 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  Uniprot ID: O75175
  ENST ID: ENST00000613636
  CDS Start-End: 343-2058

SEQ ID NO: 115251 - DNA, 4138 bp, Homo sapiens
  Payload ID: 2500
  Gene Symbol: CNOT3
  Gene Name: CCR4-NOT transcription complex, subunit 3
  ENST ID: ENST00000622131
  CDS Start-End: 1604-3865
aaattctccctgggggtaaggtaccagccctgtcctttatgggcttcttgttctaaagcatatccgtcccatatggttgctgctagtcacatgtggtgattagtaactagttaaaaatgaaaaattcagttcctccattacacttgccacatttcagatgttcagtggccaacagatatgcgcaaatagagtgtttccagcattgcaaagttctgttggatagcactgtttgccagatgttcccttctttgtgggtgaggactcttttggtgtgacttccctctgtattgaggctcttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagatcggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttacacacacacacacacacacacacacacacacacacacgcccttctctgtgagctgccagtttcatttgtctcctgacttgtctgagggatgacctctcctagccacctctgcccagcccctctgagtaggaagtgtgatttccagggctaatgcctccatcccagtcatcagctgtgtgcagcatgactgtcctgctctgaaaaacctttttgagtgtattctggggagaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatg

SEQ ID NO: 115252 - DNA, 1269 bp, Homo sapiens
  Payload ID: 2500
  Gene Symbol: CNOT3
  Gene Name: CCR4-NOT transcription complex, subunit 3
  ENST ID: ENST00000615532
  CDS Start-End: 1-865
gaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagaccacctacctaatgca

SEQ ID NO: 115253 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  Uniprot ID: O75175
  ENST ID: ENST00000622193
  CDS Start-End: 343-2058

SEQ ID NO: 115254 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  ENST ID: ENST00000620419
  CDS Start-End: 1604-3865

SEQ ID NO: 115255 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  ENST ID: ENST00000611667
  CDS Start-End: 343-2058

SEQ ID NO: 115256 - DNA, 2852 bp, Homo sapiens
  Payload ID: 2500
  Gene Symbol: CNOT3
  Gene Name: CCR4-NOT transcription complex, subunit 3
  Uniprot ID: O75175
  ENST ID: ENST00000617982
  CDS Start-End: 317-2578
gaagagaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 115257 - DNA, 2778 bp, Homo sapiens
  Payload ID: 2500
  Gene Symbol: CNOT3
  Gene Name: CCR4-NOT transcription complex, subunit 3
  ENST ID: ENST00000614542
  CDS Start-End: 1-319
gctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggatgaggggccaagcaggtgctctgcagcccctgagcctggccctgggctcgccagcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagcccagagatgttagaactgcttgggttgacagcgaggctggtccactgaggcacacctcagccccgcttccagttgcccactggctcacccgcggcccctccccagccctgctccagcagccccagtctaggccgaccccactctgctcatcggcacattctcaggcctccctggagaccactggggagctgtccagccccctcccaaccccacttctctgaaagcaattttcacctcctgtctcattttccttctcctgatcagcattggtatgttctgtgcccccagccccatctccaagaggattgtccagcccaactgtggtctgtggcgggggccggggttcagccctgatgtcctgccccattcccctggctccccacccagtttgggggccccctgatccccctctccactgttcctcccccagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 115258 - DNA, 2886 bp, Homo sapiens
  Payload ID: 2500
  Gene Symbol: CNOT3
  Gene Name: CCR4-NOT transcription complex, subunit 3
  ENST ID: ENST00000610883
  CDS Start-End: 325-2586
agagacgagaagagaggaggggaggcctcctccgccgccgccatcttggaccgggcccggtcagcttccgcggagccatcggcagacgccgcggcctcccttgagccccgacccccgtcgtcagaacaaccccgggcccactcccccaaccccacttccgcttcgcgccgctatcgcgatagcgcccgggcccggggcgcgagaaaaaggcggcgggcgctcgcctcccccgcctgtcgcgatacgctcctcagcggcggcgccagctcctgtgcgtccgtctccaagagagtatgaagagagtgcgtctgtagggcagggaagatggcggacaagcgcaaactccaaggtgagattgatcgctgcctcaagaaggtgtccgagggcgtggagcagtttgaagatatttggcagaagctccacaatgcagccaacgcgaaccagaaagaaaagtatgaggctgacctaaagaaggagattaagaagctacaacggctgagggaccaaatcaagacatgggtagcgtccaacgagatcaaggacaagaggcagcttatagacaaccgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggataagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggcagcagcggcctctcctgt

SEQ ID NO: 115259 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  ENST ID: ENST00000610829
  CDS Start-End: 343-2058

SEQ ID NO: 115260 - DNA, 2886 bp, Homo sapiens; identical to SEQ ID NO: 115258
  Payload ID: 2500
  Gene Symbol: CNOT3
  Gene Name: CCR4-NOT transcription complex, subunit 3
  ENST ID: ENST00000612924
  CDS Start-End: 325-2586

SEQ ID NO: 115261 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  Uniprot ID: O75175
  ENST ID: ENST00000615030
  CDS Start-End: 1604-3865

SEQ ID NO: 115262 - DNA, 695 bp, Homo sapiens
  Payload ID: 2500
  Gene Symbol: CNOT3
  Gene Name: CCR4-NOT transcription complex, subunit 3
  ENST ID: ENST00000616264
  CDS Start-End: 1-291
gaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcctggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagaccacctacctaatgca

SEQ ID NO: 115263 - DNA, 2886 bp, Homo sapiens; identical to SEQ ID NO: 115258
  Payload ID: 2500
  Gene Symbol: CNOT3
  Gene Name: CCR4-NOT transcription complex, subunit 3
  ENST ID: ENST00000616910
  CDS Start-End: 325-2586

SEQ ID NO: 115264 - DNA, 2886 bp, Homo sapiens; identical to SEQ ID NO: 115258
  Payload ID: 2500
  Gene Symbol: CNOT3
  Gene Name: CCR4-NOT transcription complex, subunit 3
  ENST ID: ENST00000620573
  CDS Start-End: 325-2586

SEQ ID NO: 115265 - DNA, 1125 bp, Homo sapiens
  Payload ID: 2500
  Gene Symbol: CNOT3
  Gene Name: CCR4-NOT transcription complex, subunit 3
  ENST ID: ENST00000612729
  CDS Start-End: 1-1125
accgcaagctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggatcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctcccctcccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggtggagggagcagcagcagtagtaacagcagtgccggtggaggggctggcaagcagaatggcgccaccagttacagctcagttgtggcagacagcccggcagaggtggctttgagcagcagtgggggcaacaatgccagcagccagg

SEQ ID NO: 115266 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  ENST ID: ENST00000617218
  CDS Start-End: 343-2058

SEQ ID NO: 115267 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  ENST ID: ENST00000613752
  CDS Start-End: 1604-3865

SEQ ID NO: 115268 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  Uniprot ID: O75175
  ENST ID: ENST00000618405
  CDS Start-End: 1604-3865

SEQ ID NO: 115269 - DNA, 555 bp, Homo sapiens
  Payload ID: 2500
  Gene Symbol: CNOT3
  Gene Name: CCR4-NOT transcription complex, subunit 3
  ENST ID: ENST00000619316
  CDS Start-End: 1-282
gaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatg

SEQ ID NO: 115270 - DNA, 2886 bp, Homo sapiens; identical to SEQ ID NO: 115258
  Payload ID: 2500
  Gene Symbol: CNOT3
  Gene Name: CCR4-NOT transcription complex, subunit 3
  Uniprot ID: O75175
  ENST ID: ENST00000620060
  CDS Start-End: 325-2586

SEQ ID NO: 115271 - DNA, 2778 bp, Homo sapiens
  Payload ID: 2500
  Gene Symbol: CNOT3
  Gene Name: CCR4-NOT transcription complex, subunit 3
  ENST ID: ENST00000613073
  CDS Start-End: 1-319
gctcattgagacgcaaatggaacggttcaaagttgtggaacgagagaccaaaaccaaagcttacagcaaagagggcctgggcctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaagggcgacaaggatgaggggccaagcaggtgctctgcagcccctgagcctggccctgggctcgccagcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagttacagctcagttgtggcagacagcccggcagaggtggctttgagcagcagtgggggcaacaatgccagcagccaggccttgggccccccttccggcccccacaacccacctcccagcacctcgaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggcccctgagcctctgagctccttgaagtccatggcggaacgggcagccatcagctctggcattgaggaccctgtgccaacgctgcacctgaccgagcgagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggcagtacctcccccggaacccctgtccgacgcccccctaccaccaccagatgccacccccacactcggacactgtggaattctaccagcgcctgtcgaccgagacactcttcttcatcttctactatctggagcccagagatgttagaactgcttgggttgacagcgaggctggtccactgaggcacacctcagccccgcttccagttgcccactggctcacccgcggcccctccccagccctgctccagcagccccagtctaggccgaccccactctgctcattggcacattctcaggcctccctggagaccactggggagctgtccagccccctcccaaccccacttctctgaaagcaattttcacctcctgtctcattttccttctcctgatcagcattggtatgttctgtgcccccagccccatctccaagaggattgtccagcccaactgtggtctgtggcgggggccggggttcagccctgatgtcctgccccattcccctggctccccacccagtttgggggccccctgatccccctctccactgttcctcccccagggcactaaggcacagtatctggcagccaaggccctaaagaagcagtcatggcgattccacaccaagtacatgatgtggttccagaggcacgaggagcccaagaccatcactgacgagtttgagcagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatga

SEQ ID NO: 115272 - DNA, 2886 bp, Homo sapiens; identical to SEQ ID NO: 115258
  Payload ID: 2500
  Gene Symbol: CNOT3
  Gene Name: CCR4-NOT transcription complex, subunit 3
  ENST ID: ENST00000619854
  CDS Start-End: 325-2586

SEQ ID NO: 115273 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  ENST ID: ENST00000614598
  CDS Start-End: 343-2058

SEQ ID NO: 115274 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  ENST ID: ENST00000613528
  CDS Start-End: 1604-3865

SEQ ID NO: 115275 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  Uniprot ID: O75175
  ENST ID: ENST00000620970
  CDS Start-End: 1604-3865

SEQ ID NO: 115276 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  ENST ID: ENST00000619567
  CDS Start-End: 1604-3865

SEQ ID NO: 115277 - DNA, 2886 bp, Homo sapiens; identical to SEQ ID NO: 115258
  Payload ID: 2500
  Gene Symbol: CNOT3
  Gene Name: CCR4-NOT transcription complex, subunit 3
  ENST ID: ENST00000611252
  CDS Start-End: 325-2586

SEQ ID NO: 115278 - DNA, 541 bp, Homo sapiens; identical to SEQ ID NO: 115247
  Payload ID: 2500
  Gene Symbol: CNOT3
  Gene Name: CCR4-NOT transcription complex, subunit 3
  ENST ID: ENST00000613028
  CDS Start-End: 1-267

SEQ ID NO: 115279 - DNA, 555 bp, Homo sapiens; identical to SEQ ID NO: 115269
  Payload ID: 2500
  Gene Symbol: CNOT3
  Gene Name: CCR4-NOT transcription complex, subunit 3
  ENST ID: ENST00000618717
  CDS Start-End: 1-282

SEQ ID NO: 115280 - DNA, 2886 bp, Homo sapiens; identical to SEQ ID NO: 115258
  Payload ID: 2500
  Gene Symbol: CNOT3
  Gene Name: CCR4-NOT transcription complex, subunit 3
  Uniprot ID: O75175
  ENST ID: ENST00000616359
  CDS Start-End: 325-2586

SEQ ID NO: 115281 - DNA, 2765 bp, Homo sapiens; identical to SEQ ID NO: 115248
  Payload ID: 2500
  Gene Symbol: CNOT3
  Gene Name: CCR4-NOT transcription complex, subunit 3
  ENST ID: ENST00000619557
  CDS Start-End: 343-2058

SEQ ID NO: 115282 - DNA, 695 bp, Homo sapiens
  Payload ID: 2500
  Gene Symbol: CNOT3
  Gene Name: CCR4-NOT transcription complex, subunit 3
  ENST ID: ENST00000622080
  CDS Start-End: 1-291
gaattctaccagcgcctgtcgaccgagacactcttcttcatcttctactatctggagggcactaaggcacagtatctggcagccaaggccctaaagaagcagtcatggcgattccacaccaagtacatgatgtggttccagaggcacgaggagcccaagaccatcactgacgagtttgagcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgccgaaactattttttttgaatgggcttctcaagttctaatactgggaaattcctgctgcttgcaaacactctggaaccaacctacctgggtttcagcccagtgcagctgggcgactctaggcaagtcactcgaacctctgtgtctcaattaacttatctgtaaaaatggggggaagaccacctacctaatgca

SEQ ID NO: 115283 - DNA, 4138 bp, Homo sapiens; identical to SEQ ID NO: 115251
  Payload ID: 2500
  Gene Symbol: CNOT3
  Gene Name: CCR4-NOT transcription complex, subunit 3
  ENST ID: ENST00000614649
  CDS Start-End: 1604-3865

SEQ ID NO: 115284 - DNA, 3783 bp, Homo sapiens
  Payload ID: 2501
  Gene Symbol: CNOT4
  Gene Name: CCR4-NOT transcription complex, subunit 4
  Uniprot ID: O95628
  ENST ID: ENST00000315544
  CDS Start-End: 332-2059
agcgtgcgcctgcgcacgggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagtcttttactatagcttaatttaattatggttttcatttttactgtaagaggccaagacttcacttat

SEQ ID NO: 115285 - DNA, 2594 bp, Homo sapiens
  Payload ID: 2501
  Gene Symbol: CNOT4
  Gene Name: CCR4-NOT transcription complex, subunit 4
  ENST ID: ENST00000356162
  CDS Start-End: 1081-1608
gttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggcccagcgctgctccatcacagacccaccacagcgccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtg

SEQ ID NO: 115286 - DNA, 2215 bp, Homo sapiens
  Payload ID: 2501
  Gene Symbol: CNOT4
  Gene Name: CCR4-NOT transcription complex, subunit 4
  Uniprot ID: O95628
  ENST ID: ENST00000361528
  CDS Start-End: 296-2215
accctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattag

SEQ ID NO: 115287 - DNA, 3507 bp, Homo sapiens
  Payload ID: 2501
  Gene Symbol: CNOT4
  Gene Name: CCR4-NOT transcription complex, subunit 4
  Uniprot ID: O95628
  ENST ID: ENST00000451834
  CDS Start-End: 285-2417
agatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtgaca

SEQ ID NO: 115288 - DNA, 4642 bp, Homo sapiens
  Payload ID: 2501
  Gene Symbol: CNOT4
  Gene Name: CCR4-NOT transcription complex, subunit 4
  Uniprot ID: O95628
  ENST ID: ENST00000428680
  CDS Start-End: 281-1999
ggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagagccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggggaagaagaggtgaaggtttcgaccatgccactgtcaacctcttcccattcattacaacaaggacagcagcctacaagtctccacactactgtggcctgacaacagaactgagaggagaggattagactctggggtgcttgcatgggcaactggatttttgcatgattcctttatgattttgcttttaatgtatacacccagaagagccaatataaacgttcctcatgcctacagctagcgtgttacctcatagttgttgaagtatttcttcattaggcctttaacataatttattagtgtaataattttggcattgtttctcatgagtgatactatttctaactcataaaaataaacttgtagtactaagatcccaggtgagattagctagaattgttgttattttggctctattattgaaaaattatacaaaggtaatggtagtatcttgttttctggtttgtgaaaaaataatatcctaatctcctgaaaaatttgcaaattaacaagataatgtctattgcattctttgaatacttgagaagaaagaatacatataaaacaaaattggtggtgtcatttaatgctcagaaggatattgttggcgattgtttttagttgtctagatttatatcctataatatgcattacatgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagtcttttactatagcttaatttaattatggttttcatttttactgtaagaggccaagacttcacttatgtctcctgtggagctgaggctcctgggccttgttattataacaaactctggctccttgtaatgatgcttactagctcaaagccttctccagcattcagtgttagcctttcattgcctggatcttcttacaaagccatagcaagtggttagtgccatttgctccttggtgttgagagatatacctgttaaatgaggcttctttcctttctcattcatagccagcgtggaaaaatcatcaggtagtttgcccagatttgccagagccctaaataaaatggcaaaacgatctccctgcctgcttctcctccccacccccacttacatgcacaccgtaaatcaagaaatgctttttgggcaattagactttatcttctaaatttttgcatagaatggctaaacatgatcttttgcctcactttgtaattcctacaccttccttgtaagcttcaccttttgcttacctaatattttatttaaacatggttttttaaaaaacctgaagctttaaaatcatagtcataattaattttacactaaaggacagaagaaattatacaacacataaaagaagccactacttcacatagcaagcaaattgaaatcaaaatgacagaagaatgagaaattctttaaaagcttcaggttttttttgttgttgttgttaaattcctgcatgatgcatcatgtgcaagggaaacttaatatacttttacacccttaacctttataaagtgactagcttttcccttaacataggaatttttaacctggagcccagatttttgagagtacacacaaaattgtgggtttgtgtgcatgtacatatgtccatttttttctagggagaagatccatagttattagatttgtgaaggatttggtgatccccttctcccatcaaaaaaaaaaaaaaaaagaa

SEQ ID NO: 115289 - DNA, 3297 bp, Homo sapiens
  Payload ID: 2501
  Gene Symbol: CNOT4
  Gene Name: CCR4-NOT transcription complex, subunit 4
  Uniprot ID: O95628
  ENST ID: ENST00000423368
  CDS Start-End: 282-2210
tggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtg

SEQ ID NO: 115290 - DNA, 1687 bp, Homo sapiens
  Payload ID: 2501
  Gene Symbol: CNOT4
  Gene Name: CCR4-NOT transcription complex, subunit 4
  Uniprot ID: O95628
  ENST ID: ENST00000414802
  CDS Start-End: 1-1302
atgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagaccttacagagccaattgagaggaagagactggcagtgctgaagagaagataggctcattcagtaggataatagatgtcgttgggtggtgggaagagataagctcctgagacgagcatgtggtatagcttaagagaggtgggtggccaggcgcggtggctcacgcctgtaatcccaacactttgggaggccaaggcaggcagatcacaaggtcaggagatcgagaccatcctggctaacacggtgaaaccccgtctctactaaaaatacaaaaaaattagctgggcgtggtggcgggcacctgtagccccagctactcgggaggctgaggcaggagaatggcgcgaacccaggaggtggagcttgcagtgagccgagatggtgccactgtgctccagcctgggcaacagagcgagactccgtctaaaaaaaaaaaaaa

SEQ ID NO: 115291 - DNA, 3563 bp, Homo sapiens
  Payload ID: 2501
  Gene Symbol: CNOT4
  Gene Name: CCR4-NOT transcription complex, subunit 4
  Uniprot ID: O95628
  ENST ID: ENST00000541284
  CDS Start-End: 332-2473
agcgtgcgcctgcgcacgggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggctaccagatttgccgattttgttggcatcgaattcgcactgatgaaaatgggctttgtcctgcatgtagaaagccatatccagaagacccagcagtttataaaccactctcccaggaagagctgcaaaggataaagaatgagaaaaaacagaaacaaaatgagagaaaacagaaaatatcagaaaatcgcaaacatttggctagtgtacgtgtcgtacaaaaaaacctcgtctttgttgtaggtttatctcagcgcctagcagacccagaggttttaaaacgaccagaatattttgggaagtttggtaaaatacataaagttgtcatcaataatagcacatcatatgcaggctcacagggtccaagtgccagtgcttatgtaacctatatccggtcagaagacgctctcagagccatacagtgtgtcaacaatgtggtagtagatggcagaacacttaaggcatctctaggtacaacaaaatactgcagttacttcttaaagaatatgcagtgtccaaaacctgactgcatgtatcttcatgaattgggggatgaggcggccagcttcacaaaagaggaaatgcaggcgggtaaacaccaagaatatgaacagaagctacttcaagaattatataaattaaatcccaattttcttcagctatctacgggttcagttgataaaaataagaacaaagtgacaccactgcagaggtacgatacccccattgacaaaccttcagattctctcagtatagggaacggtgataattcccagcagatatctaacagtgatacgccttcaccaccacctggtttgtcaaaatccaatccagtcatccccatcagttcatccaatcacagtgcacggtccccttttgaaggggcagtaacagagtcacagtcgttattctcagacaattttcgccatcccaaccctatcccaagtgggcttcctcctttccccagctccccacagacatccagtgactggcctacagcaccagaaccacagagcctcttcacatcagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcagacaacagcagttctgtagagagtttaaatatgaaggaatggcaggacgggctaagggcacttctacccaacattaacatcaactttggtggactgcccaattcttcttccccctccaacgccaaccacagtgcaccaacgtccaacactgccaccaccgacagcctgagttgggacagccctggcagctggacagacccagccatcatcacaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtgaca

SEQ ID NO: 115292 - DNA, 6176 bp, Homo sapiens
  Payload ID: 2502
  Gene Symbol: CNOT6
  Gene Name: CCR4-NOT transcription complex, subunit 6
  Uniprot ID: Q9ULM6
  ENST ID: ENST00000261951
  CDS Start-End: 350-2023
caatgaaaacgaggggggcgcggaggaggaggcggcggcgtcggtggcggcggcgacggcggcgcggaggcgaaggcagcggcgggcgcagcgaggagggcgaggccgggggccgagagggcgggagggcgtagtggcggcccgtcggggcggctgaggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagta

SEQ ID NO: 115293 - DNA, 6303 bp, Homo sapiens
  Payload ID: 2502
  Gene Symbol: CNOT6
  Gene Name: CCR4-NOT transcription complex, subunit 6
  Uniprot ID: Q9ULM6
  ENST ID: ENST00000393356
  CDS Start-End: 425-2098
ggcgcggaggaggaggcggcggcgtcggtggcggcggcgacggcggcgcggaggcgaaggcagcggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaacattgtgttggggttataataattcattaaatgtcttgttgcctgta

SEQ ID NO: 115294 - DNA, 706 bp, Homo sapiens
  Payload ID: 2502
  Gene Symbol: CNOT6
  Gene Name: CCR4-NOT transcription complex, subunit 6
  ENST ID: ENST00000504343
  CDS Start-End: 3-706
gcatgcccaaagaaaaatacgagccccctgaccctcggaggatgtatacaattatgtcttctgaggaagcagcaaatggaaagaaatcccactgggcagagcttgaaataagtggaaatccccttacccaggatatattgaacctttatcaggaaccagatggaacaagacggctgctgaactatttgcttgataatttgtcagttacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtact

SEQ ID NO: 115295 - DNA, 6250 bp, Homo sapiens
  Payload ID: 2502
  Gene Symbol: CNOT6
  Gene Name: CCR4-NOT transcription complex, subunit 6
  Uniprot ID: Q9ULM6
  ENST ID: ENST00000618123
  CDS Start-End: 428-2101
gcgaggagggcgaggccgggggccgagagggcgggagggcgtagtggcggcccgtcggggcggctgaggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgcatgcccaaagaaaaatacgagccccctgaccctcggaggatgtatacaattatgtcttctgaggaagcagcaaatggaaagaaatcccactgggcagagcttgaaataagtggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcagggagctccatttaaataacaacctgttacgagttctaccttttgagctgggaaaactgtttcagttgcagactttaggcctgaaaggaaatccccttacccaggatatattgaacctttatcaggaaccagatggaacaagacggctgctgaactatttgcttgataatttgtcaggtactgcaaaaagaattacaacagaacaaccacctccaaggtcttggattatgttacaagaaccagataggacaaggccaactgccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaaatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatac

SEQ ID NO: 115296 - DNA, 4024 bp, Homo sapiens
  Payload ID: 2503
  Gene Symbol: CNOT6L
  Gene Name: CCR4-NOT transcription complex, subunit 6-like
  ENST ID: ENST00000515506
  CDS Start-End: 1-1408
gtgtgtgtgtgtgtcgggggtggcccggggccgggaccccagagtggcgtgtccctcccgctttgtggctgcggctcccgagcctcgcagactaatagggatgccaaaggaaaaatatgatcctccagatcctcgcagaatttataccatcatgtcagcagaggaggtagccaatgggaaaaaatctcactgggcagaattagaaatctcgggtagagtgcggagcctaagtacatcactttggtcattgacacacttgacagcgctgcacctaaatgacaattaccttagtcgcattccacctgatattgccaagcttcataatctggtttacctggatctgtcatccaataaactcagaagtttaccagcagaactaggaaacatggtgtctctcagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcagttcatccagagcagcttcctccgaggccatggattacattaaaagaacgagaccaaattctgccgtcagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaagggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaa

SEQ ID NO: 115297 - DNA, 8843 bp, Homo sapiens
  Payload ID: 2503
  Gene Symbol: CNOT6L
  Gene Name: CCR4-NOT transcription complex, subunit 6-like
  Uniprot ID: Q96LI5
  ENST ID: ENST00000504123
  CDS Start-End: 132-1799
gtgtgtgtttcccctgccgcggggaaatggctgctgttgcttctgggccagaggaagagaatgaggtagagtgttcttttgcctccgagtaggaccgagagtgttgggaagaggagcgcgtccccggggaaatgagactaatagggatgccaaaggaaaaatatgatcctccagatcctcgcagaatttataccatcatgtcagcagaggaggtagccaatgggaaaaaatctcactgggcagaattagaaatctcgggtagagtgcggagcctaagtacatcactttggtcattgacacacttgacagcgctgcacctaaatgacaattaccttagtcgcattccacctgatattgccaagcttcataatctggtttacctggatctgtcatccaataaactcagaagtttaccagcagaactaggaaacatggtgtctctcagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcagttcatccagagcagcttcctccgaggccatggattacattaaaagaacgagaccaaattctgccgtcagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatatataaccttattggaagtattaattctaagcctgtctctcaagtttatttatagagaaaaagtaagtaatctgtattgccacataccttgaaaatagaatgtggtatgtttaggatgcccacggaatgaatttttccttattccaattcaaccttctgtctggttgtgccaggaaaacagatgttatatgacctatgtcatttttgccattatagtcaaatgttaaaagaagaaaaaagtctgctgaataaaaaggccttgatcaaagtttcagatggggaaaatcatacagatattttatgtgtttccaacatagattatgtggctgttggtttcttgagatgacagtgcaaaggatttgggagagagaacaaatttggggcagtagttgaaaacgttgggtcattttcctgactctagctgccaaatggccatcatatgcttttaatctttgtttcagttgtctgtcagggttgaattaagaagctactggtttattcccaattgttgatgcctttaggtatgttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatatatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcatacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttttttggtgtcttaaagttatatattaaatcacagagaagcaagggagaaagttgaaagatatctaaggctcatatcacttgattctatggtagattatattagaattgaggatgtggcacattaaaactggaacatgggcaaatatagtgttccattttaaaattctaagtttatattgttaaatgggtgaaaatttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagactttatggcacattttcaaaatagcactcatacatacttacattttgacagaaatgtgaattctcacattgatgagatattctttttcccacctgccctaccctttaaaaaaggtcacttttctaatgtgtagtagattcatttacgcctttccctttgagtcataccatgtttggagaactgtgtgaattgtaggtagagaaattaactagggaagccagaagcttgaactaaagttttaaatttgtaggcagatgagaacttttatactatggttgctttgggcgattctaattttgtaatagcatcatgatcaccaaaattaattcaaacattttagtacatctttaatctgtcttatttaccaaagttctaatctgtttaagaacaggatgccaagagcatctttcattttatagaatgatatgctcacctttataagtgtcacctaaaagcttgagggtaaaaaagaagcagcccatatatctaaactacaggatgtcttgaacaagattcacagaaagaaagaaaaaaaagcagttctttccaggaaggtggtaaggaagagcatgcatatttcttgttttaaccaaataccttttttatgtaaatgtctctattaaaccccaggtcctacaccaggaaatagggtgataaccaggaaaataccaagctttaacccagttggcagttccttgtggcatacatttggttagacttgggtttttcctggaaccaaaggaaaataagcatgttgagttcttcgttcaacagacatgacattgaagtaatagaatattttttaagtaaaatagttttcactttcaaagcctatgacataaggacatttgtgcttattaattgttaatttttttttatggtacattgtataaactgagtagcattgaactgcattttagaagtatgtcatcagaaacaaatcacattatggaaaggatatacaaatgccaagtgatatgactcttttggcatggtggtagcatggtccattcagctttcagaatctttcggaggctctagtttggtgcctagtactagttatttttgttagaacaatctctcaaaatttagataattttccagttgtatgtctgtcacttttaactctaaagcgtaagaatcatggtaaccctctcagaagtggtcctttcttgctcatttcagtttcgtattaacttcaaatcactgatgtattgtctttcaagctatcaattgttatatgtaccaatttaatttagtttgtagttatctgaagtcacaaaattggttcagcattgatgtcaaacaatggctttgcttcttaccaaacagacttagtatcctgctgcttgtttcaatcttgatgcagtaagtgatgcagtatctgggtctgtatttacttagaaactgtactgtcctttctctgtgcttaacttgctaaaaatatattcccttacctgtgaaattcctgagcggtgctctgccaacttttcaaggggagggatttggatggctgtgttactgcacactggatctggaattgttcagggttatgagtgacaaatttcttaaacaccagcagcactgagatgtgcactatgggcattcgtacagttgttgtccaaatgcaaacaactttttcatcttggagaagctgagatacagagttcaatagaactacttggaatattttgagaaggttgaatgtttcatctttggctttgttgtctctggagtggggaagtatggagggctttttttttttttttttttttttttttttttttttttaaagagagtgtgtatgtactttttctctctataagggccagggtgttggtcaaattcaccatcgattaatttatatcttctgttgtgatttttttcaactatataacaagtgccaactaattgtccatgggacaatctacttttccactcaatttatcgttttgagtagggaaaggttcatttattttcattacctggcattaagttaaagaattcattattttgcatacatttgagtcattctgtgacctataaagtgtttttgtaactatctaattctaatggttgcaaagcaaagcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaacttgtttttgtgtttcagtaatcagtttaaaatctaagatttttttttaaattagactatttaatgaagtgccatgtaattgtagcttgctagtgtttaatgtttaatagactggttctgtaggtgttttaaccatttaacactctctgccatccctggagaaagtggttctactcttactgaacacattctctctgacaaaatcaccagctgctttatttttctatttattacagttaaacagttgatgaggtctgaatcttgaccaaaactgctcagctgagatgtttttcacaatagacactgtacaaagtgtgcgtgcaaaaggacacggttggtagtattttttcattaatgtgaacattgactaaaaaaaagcagtcctgccttttaaatcttgtggcagctcagaagggaggtgcttaagaaccttaactactatgtcagataacaaaatatttttttccattttggagattggttactgctcacacatgatgtatagggctaaatatatgcttgtttccttgcacctgtgtacttcccctctctccctccctttccttcccctgtaggcaataaatggccattttgcaactgca

SEQ ID NO: 115298 - DNA, 1890 bp, Homo sapiens
  Payload ID: 2503
  Gene Symbol: CNOT6L
  Gene Name: CCR4-NOT transcription complex, subunit 6-like
  ENST ID: ENST00000512485
  CDS Start-End: 1-1689
cccggaccccggcgcgctgaatgcagactaatagggatgccaaaggaaaaatatgatcctccagatcctcgcagaatttataccatcatgtcagcagaggaggtagccaatgggaaaaaatctcactgggcagaattagaaatctcgggtagagtgcggagcctaagtacatcactttggtcattgacacacttgacagcgctgcacctaaatgacaattaccttagtcgcattccacctgatattgccaagcttcataatctggtttacctggatctgtcatccaataaactcagaagtttaccagcagaactaggaaacatggtgtctctcagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcagttcatccagagcagcttcctccgaggccatggattacattaaaagaacgagaccaaattctgccgtcagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctct

SEQ ID NO: 115299 - DNA, 1925 bp, Homo sapiens
  Payload ID: 2503
  Gene Symbol: CNOT6L
  Gene Name: CCR4-NOT transcription complex, subunit 6-like
  ENST ID: ENST00000504804
  CDS Start-End: 69-209
gtgtttgtgtgtgtgtttcccctgccgcggggaaatggctgctgttgcttctgggccagaggaagagaatgagactaatagggatgccaaaggaaaaatatgatcctccagatcctcgcagaatttataccatcatgtcagcagaggaggtagccaatgggaaaaaatctcactgggcagaattagaaatctcggagtgcggagcctaagtacatcactttggtcattgacacacttgacagcgctgcacctaaatgacaattaccttagtcgcattccacctgatattgccaagcttcataatctggtttacctggatctgtcatccaataaactcagaagtttaccagcagaactaggaaacatggtgtctctcagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcagttcatccagagcagcttcctccgaggccatggattacattaaaagaacgagaccaaattctgccgtcagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaaggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtat

SEQ ID NO: 115300 - DNA, 572 bp, Homo sapiens
  Payload ID: 2503
  Gene Symbol: CNOT6L
  Gene Name: CCR4-NOT transcription complex, subunit 6-like
  ENST ID: ENST00000515441
  CDS Start-End: 83-572
gcgcgcgcgcgcgcgtgtttgtgtgtgtgtttcccctgccgcggggaaatggctgctgttgcttctgggccagaggaagagaatgagactaatagggatgccaaaggaaaaatatgatcctccagatcctcgcagaatttataccatcatgtcagcagaggaggtagccaatgggaaaaaatctcactgggcagaattagaaatctcgggtagagtgcggagcctaagtacatcactttggtcattgacacacttgacagcgctgcacctaaatgacaattaccttagtcgcattccacctgatattgccaagcttcataatctggtttacctggatctgtcatccaataaactcagaagtttaccagcagaactaggaaacatggtgtctctcagggaattgcttttaaataacaatctgttacgggttttgccttatgaacttggtcggctcttccagctacaaactctaggtttgaaaggcaatcctttatcacaggatattctcaacttataccaggacccagatggaacccgaaagctactgaacttcatgcttgacaatctcgcag

SEQ ID NO: 115301 - DNA, 781 bp, Homo sapiens
  Payload ID: 2503
  Gene Symbol: CNOT6L
  Gene Name: CCR4-NOT transcription complex, subunit 6-like
  ENST ID: ENST00000505983
  CDS Start-End: 1-781
ttaaaaagctgccattgtcaagtagcagctgctagcaatcaggaagtggaaacagagcaatacttcactctctttctgccagcattgaaggagcgtggatatgatggatttttttctccaaagtcacgtgccaaaatcatgtctgagcaggagagaaagcatgtagatggttgtgcaatattcttcaaaacagaaaaatttacattggtgcagaagcatacagtggaatttaaccaagtggcgatggctaattcagatggatccgaagctatgctgaacagagtgatgacaaaagataacattggtgtcgctgtggtattagaggtccacaaagaactatttggagcaggtatgaagcctattcatgctgcagacaaacagctgcttatagtggcaaatgcccacatgcattgggacccagagtattctgatgtgaagctcatccagaccatgatgtttgtctcagaggttaaaaacattctggagaaagcctctagtaggcctggaagcccaactgcagatcctaattccatcccgctggtgctatgtgcagatcttaactcattgccagattcaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaag

SEQ ID NO: 115302 - DNA, 6913 bp, Homo sapiens
  Payload ID: 2504
  Gene Symbol: CNOT7
  Gene Name: CCR4-NOT transcription complex, subunit 7
  Uniprot ID: Q9UIV1
  ENST ID: ENST00000361272
  CDS Start-End: 300-1157
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacggtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataaatgttgatgactggtgattttcttttggaaatacttatttgggggatattgttcatttttatttgggcaactcaacagaattcagtaacttccttcattaaccctagatgattattagtccattaattgaaaaatcagtctgagttttctgcatttcaagtgttggcttattcttgttctttatgagtacctcaactagctaattaaggactgacttctgtttctcctttccaggaatgcatttattccgaaggatatacttcacaaagtaaatacatttggtataactgtggctttttaaaaaatctaacacaatgtagtaagtttctaactggcttcttttgtcttcgttaaaaaggaagtgaagcttcttttcgcttgtgatttgttagctgagaaaactaatatttaaattctgttcaactatttgagaaatcaatgctggatttcaaataggaatgataaagattgcctttttattagccacatagttgctcaatctcataacttgtatcatttctggcttctgtccctaaaaagtatagataatccctaacttactttcgacttaatgatttttcaactttacagtgggtgtattgagaggtaaccccatcaaaagtttaggagcgccttaggaccaaagatggggttatagtttctactgaatgtgtattgcttttgcaccattgcaaagtcaaaatttataacttgaaccatcgtaaattgggggactgtatgctgttgcctgcattaaatgcatcttagtattttttcagatgtaacctcattgtaggttgagcaaccgtatagtgtaacttttgtagaggaacattttgacttttactgggtctaagttttacttttttattttgttccagacagtctcaatgtttgtaaagtctaggttccagatgtaagatatttggctgatattttagtgttactgagccattaattaattacaggctcatatattctgttaaatctactagagcaagggttgtcaaactatggcccgtagccagaatcagcttgctgcctgtttttgtgtggcccatgaactgaaaatggcttttaaatggttgggaaaaataatcaaaagattatttcctgacatctgaaaattacatgaaattcaaattttagtgtctataagtttttattggaatgcagccacactaatttacatattatctatggatacttttttgctataatgggaaagttgagtagctgctacagaacctgtgtatgtgtgtcttgtttcacattgccgcttggcaagctacagaatcatggtgatgcagatattacctgaaagcatttggaatgccctgtgtattgctagatttattactttttctgctaccagttcatgccctgtatctcagaacaagaaaagtacctttgaatgttacactttcaaggcacattggaatatggactattttattatatgctggtacattgtgtttataatgcagtgtcaccataactggtaaaagaatagactgacagtatcagactaacatcacaatattcccaactggtgggaaagcaacagtcagaagaattagaaaatttaaatgaaacatcacagcaaaatttcacaaaagtaataaaaatgaggctgcaaccaaaatgtttacaagtagcctatttgttagccaagcaaagaaaaccatttactaatgctgaattacatcgtgcttgaagatagtaaccaacccaaagacatgtgtccagagaaaattaagacatcagccctttgatgagaacagtagtttgaagaatgaggattttggacacaacatcaaatgacactgttaattctttgcctcttactagtcagtactgcctagctttattttttgagaaaccattgctggatttgaagtgatcgaagaatttgtatggaactacaagtgggaatattttcaaaaaagttgataaacagtacaacctgaagtggaatctactaagatgtgatgcaaccgatgctgggaaaaatgcatgaagcagaaaaaaagtttatttggtcaaattttaaggcttgtgaaaacgtaagttgtttaaagcctgtagttactcacttgattattcatcagcaggtacttcacaggaaatattggtgttactgaactggtcaacagttaacttcatttgctcttgtggacttaaccatcttcagttccatgatttttttttttttgtgagaaacagaagctgaatatcctgatttgatttgccacacaggcgttcaatggcttagcagtgctaaagatttatttttatttttttgggctctgggctgacattgaaatttttctgaatgagaaaaaccatcctcaaccactgttttttaacactgagtaactttggaaattaacttttgccacagacttgaaaatgtttcttaatgaatttgacctgaaattacaaggtacaacaacataatatggtaaattcatttcaataaaaactaaaacttaagattgtcaagctgctttatatactttctgtgctatgagaagtcaaaacagcgctgtattgccaaatccatttttagtggatatattttcctgtagcagttttttggaccttgatgcagtgcaaagaaaatttttaaattttaaaagcatttaactgcaattaaatgcttttaaagtttcctcttaatcttctgttggaaatgaatcatcttgaatgaatgacatgctaaagggcaaataccaaaaagatgaatcctacaaatgccttacaagtgatgaatatgcttaactaaaatcacatgctcatgggtggatgtgtcagtatttagcagtaccttgacctgtttgtgtgaaaagacattttcaaagatgaaatacgtgaaatcccattacacatcagcattaacagattaacattttctatttattccaatgaggggataccaactttcagcccaaattgagcaaaatgttacctcccgtcccctgccaaaaaatcccattattcccattagtagaactctattactaaaaaaagaaaaaaaaattgtactcaatattttgagttttcaatttttagaataaaaatttggtgaaaagtttccttgagtacctaaataatgtccttcattttgtcttagcttgcaaagcctctaatatttgctacctgcccttttcaaaaaaaaaaaaaaaaaaaaaaaaaaggcttgtccacctctctactagaagaaactcaagggtctatgtctgtcctgtttgctatttcatctgcattgccaaatgcagtggctcctctgggtaggcaacctgaggtggaatcaaattatgaatgcatatgttatctcatgtctataaaataaatgtgttagaatttataaataaagggataggaaaaatgctgattattctgtgtgtcggtgctttgtagtgaaggccagttcacacatgccatttgctatgttggtgtaatttatatgagagtttcttttataacaacgttacctgtcatttatttttctattaagacattatagaaacgtaggactgtacacatccaaatcctgcagaattttcatttcaggttttgaaagttaaaaaaatgtcaccatagaatgaaaattccaagaaaacaagattcatgtacattatcactagacaatttccatttgttttaaacagttttctacagcattagttacatttaacgtttagtataaaagcaattgagcaatttctctttagaagtccatttcattgctttgtagccatagtctgtaggtgaatgaacaagctacatttctccagaattactcattttctttttaaagataaactggtcaatactctccttcctggtatggaggaattttttgtatatgagaagcattcatgaatataatctgccctcttgctttattgtcataggaggggaaattcactgctttcacacccttctgttttggctctttctcccaaaagataagaatctttatttagtatcataccaagaaattggagttcctttagcttcagactatcatcatggcttccaaattgttaggaaatacaagtttgcaagaccccaaggggacttaatattttacatcttactagccatgtcataggttttaagtgcttttaatggggaactgtttcactcatgccatatacctgttttgtttttctaaaaaattaatactgtaagttgtgagcaggtgtcttgtatcactgcgaaacccatgcataataaaaacttgttcttgagctata

SEQ ID NO: 115303 - DNA, 680 bp, Homo sapiens
  Payload ID: 2504
  Gene Symbol: CNOT7
  Gene Name: CCR4-NOT transcription complex, subunit 7
  ENST ID: ENST00000519918
  CDS Start-End: 1-626
atgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaagtaaggcttcggatggcattatctacagcagcacactgttcagaccaagtgactgtcatgcgagcctaggctgggatgttgttttaaaccatattttaaagtattacagtgaatgcaattata

SEQ ID NO: 115304 - DNA, 768 bp, Homo sapiens
  Payload ID: 2504
  Gene Symbol: CNOT7
  Gene Name: CCR4-NOT transcription complex, subunit 7
  ENST ID: ENST00000518021
  CDS Start-End: 279-467
gtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatgggttttggtgttgagaaaaaccttgtgtcagagaagcaattggaaagtacagggcgttttcccctcttttgaaccagttcttcaagaaacttggttttagcattggaatactgtgagcatcatttcatgtatcctttgggagacaggaatttatgattttcccccctttcttggttatagagacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttg

SEQ ID NO: 115305 - DNA, 568 bp, Homo sapiens
  Payload ID: 2504
  Gene Symbol: CNOT7
  Gene Name: CCR4-NOT transcription complex, subunit 7
  ENST ID: ENST00000520178
  CDS Start-End: 447-568
agtgggacggaaattgggagtggagggcggtggcctagatcctcacctcttcgtattgtttcacgcggcagtgcttgggagtcagtgtagctccagtcagtgttatcagcaccttcgcactggcgctttgccagggaagagagttatctatggcttgaatacctcggtgccgtcctctcgtttctctgggaaactgcagtacggagatgctttctccagtaatgagaaggcctttggtgtctcttcggggcttctgggactgcagtagagagagagaaggatttgaaatttccctgcccaagaatcaacaggaactctgtttatagaccagaaatgtgacatctatctttggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacac

SEQ ID NO: 115306 - DNA, 1885 bp, Homo sapiens
  Payload ID: 2504
  Gene Symbol: CNOT7
  Gene Name: CCR4-NOT transcription complex, subunit 7
  Uniprot ID: Q9UIV1
  ENST ID: ENST00000523917
  CDS Start-End: 300-1034
atctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagtaaagatataattagagataccatatgagtcacatccaccacacttaaaagtattcaaaaataagtcatcttgaaatgtagttcagaaggaactgggagaacatgttcatcatagaaccaacaattttaaaacataaactacctgagaagtcatgtaggtccaaccatattatttctcaggtgagaaaacaggctaataacttccatgattaaacacattactagtgggagaactccagagttcttttctgactcccattggtgctcctcctacaaggcaaggaatctttatattaggtttattctagcatgaccccttttaaggtttaaactggtgataaatatattatttgctcatgtcattcttcagtgctttgaagattttatagagaagaactcaggctcttttactgcattgagtcttaaaaggggggttgaattccgaagggatcaaataaatccaacgtagtagttgcatcagaaaccatattaggaaaaccctccttaaacggcaaaaggcagagatcagttccttgagtataaagtgttagggatggaagaatgaaactaaatgaacccattatctactcctaagtaattaagtgatgtgcacagatacacctagctataggtaaacaggaaaattggttgtgcaaaaaacaagtgaggtttttcttgactataagttttcccttttggaaaaattcgctgtggatttgagtatattttctcttagacattaaattgagactgagaattt

SEQ ID NO: 115307 - DNA, 1209 bp, Homo sapiens
  Payload ID: 2504
  Gene Symbol: CNOT7
  Gene Name: CCR4-NOT transcription complex, subunit 7
  ENST ID: ENST00000519954
  CDS Start-End: 279-434
gtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatgttcttcaagaaacttggttttagcattggaatactgtgagcatcatttcatgtatcctttgggagacaggaatttatgattttcccccctttcttggttatagagacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcatagcggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaggtggattacaggaggtggcagaacagttagagctggaacggataggaccacaacatcaggcaggatctgattcattgctcacaggaatggcctttttcaaaatgagagaagtatgaagacatcactgcctttttctcagttggttgttaggttgagaacattaaaaatcttgtggccaaagattttgggcaacaagtacctactaagt

SEQ ID NO: 115308 - DNA, 700 bp, Homo sapiens
  Payload ID: 2504
  Gene Symbol: CNOT7
  Gene Name: CCR4-NOT transcription complex, subunit 7
  ENST ID: ENST00000524358
  CDS Start-End: 258-700
gggacgatgaacctgagagggtgcgcgatggcgccagctggagtgcggctggcggaggaaggagcctggcggcgggttgggggctggaaggatttgaaatttccctgcccaagaatcaacaggaactctgtttatagaccagaaatgtgacatctatctttggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacggaggacatgtatgcccaggactctatagagctactaacaacatctggtatccagtttaaaaaacatgaggaggaaggaattgaaacccagtactttgcagaacttcttatgacttctggagtggtcctctg

SEQ ID NO: 115309 - DNA, 426 bp, Homo sapiens
  Payload ID: 2504
  Gene Symbol: CNOT7
  Gene Name: CCR4-NOT transcription complex, subunit 7
  ENST ID: ENST00000518541
  CDS Start-End: 1-274
cggttacgactttggctacttaatcaaaatcctaaccaactctaacttgcctgaagaagaacttgacttctttgagatccttcgattgttttttcctgtcatttatgatgtgaagtacctcatgaagagctgcaaaaatctcaaaatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccg

SEQ ID NO: 115310 - DNA, 432 bp, Homo sapiens
  Payload ID: 2504
  Gene Symbol: CNOT7
  Gene Name: CCR4-NOT transcription complex, subunit 7
  ENST ID: ENST00000628418
  CDS Start-End: 277-432
gcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatgttcttcaagaaacttggttttagcattggaatactgtga

SEQ ID NO: 115311 - DNA, 2528 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000285896
  CDS Start-End: 296-1174
gggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcat

SEQ ID NO: 115312 - DNA, 2604 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000403027
  CDS Start-End: 373-1251
agagagcaggcgagtcgggcggatcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggca

SEQ ID NO: 115313 - DNA, 692 bp, Homo sapiens
  Payload ID: 2505
  Gene Symbol: CNOT8
  Gene Name: CCR4-NOT transcription complex, subunit 8
  ENST ID: ENST00000517568
  CDS Start-End: 338-692
ggatcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaact

SEQ ID NO: 115314 - DNA, 923 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000520671
  CDS Start-End: 344-904
gttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagg

SEQ ID NO: 115315 - DNA, 648 bp, Homo sapiens
  Payload ID: 2505
  Gene Symbol: CNOT8
  Gene Name: CCR4-NOT transcription complex, subunit 8
  ENST ID: ENST00000519903
  CDS Start-End: 392-648
agagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccat

SEQ ID NO: 115316 - DNA, 623 bp, Homo sapiens
  Payload ID: 2505
  Gene Symbol: CNOT8
  Gene Name: CCR4-NOT transcription complex, subunit 8
  ENST ID: ENST00000522458
  CDS Start-End: 261-623
ctagagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagagatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgcca

SEQ ID NO: 115317 - DNA, 862 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000523698
  CDS Start-End: 285-845
aaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgca

SEQ ID NO: 115318 - DNA, 1027 bp, Homo sapiens
  Payload ID: 2505
  Gene Symbol: CNOT8
  Gene Name: CCR4-NOT transcription complex, subunit 8
  ENST ID: ENST00000522644
  CDS Start-End: 201-554
gccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacatataagaaagaaaaagtcaacaataatacatgtgttgcttgagctaaaagacataggagaacagacaacacatacccattacatttctaggaaatacgagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaa

SEQ ID NO: 115319 - DNA, 1068 bp, Homo sapiens
  Payload ID: 2505
  Gene Symbol: CNOT8
  Gene Name: CCR4-NOT transcription complex, subunit 8
  ENST ID: ENST00000521729
  CDS Start-End: 236-394
agagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatgagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaag

SEQ ID NO: 115320 - DNA, 500 bp, Homo sapiens
  Payload ID: 2505
  Gene Symbol: CNOT8
  Gene Name: CCR4-NOT transcription complex, subunit 8
  ENST ID: ENST00000519394
  CDS Start-End: 231-500
agagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttct

SEQ ID NO: 115321 - DNA, 620 bp, Homo sapiens
  Payload ID: 2505
  Gene Symbol: CNOT8
  Gene Name: CCR4-NOT transcription complex, subunit 8
  ENST ID: ENST00000519211
  CDS Start-End: 265-620
gtgaccaggcgcgcgcgcgcgtctggagtgactctagagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactc

SEQ ID NO: 115322 - DNA, 562 bp, Homo sapiens
  Payload ID: 2505
  Gene Symbol: CNOT8
  Gene Name: CCR4-NOT transcription complex, subunit 8
  ENST ID: ENST00000519430
  CDS Start-End: 396-562
tcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggccttgattgcttgcagagaaaactttcctgtggctttatcattagttgcccttcagagctttcctgtgtaaataagaagctatgttttggagaagtttacaccgtagatgaacgggagcgatctgaacatactgcactgcaggtcaacacagagcagggacttcagtaattcataggtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtag

SEQ ID NO: 115323 - DNA, 920 bp, Homo sapiens
  Payload ID: 2505
  Gene Symbol: CNOT8
  Gene Name: CCR4-NOT transcription complex, subunit 8
  ENST ID: ENST00000518775
  CDS Start-End: 245-920
aagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtgtgagagaccattggggatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggaga

SEQ ID NO: 115324 - DNA, 904 bp, Homo sapiens
  Payload ID: 2505
  Gene Symbol: CNOT8
  Gene Name: CCR4-NOT transcription complex, subunit 8
  ENST ID: ENST00000524105
  CDS Start-End: 444-830
atcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttcccc

SEQ ID NO: 115325 - DNA, 516 bp, Homo sapiens
  Payload ID: 2505
  Gene Symbol: CNOT8
  Gene Name: CCR4-NOT transcription complex, subunit 8
  ENST ID: ENST00000518028
  CDS Start-End: 351-516
ctaggagcagatccggggtagagggaaaagagctccgggccaggggctgccgtcgccgccgtcggggagtcagcccgccagcccgccagctcgtcagcccgccagccagcgcttcgcgggccctgtcggtcccgttcttgcggccccataactttttcttggtgttctatggctttatgaatggaggagccaactcacagacctgggccattcgggtggttttaagaagtttgaactgcggttcaatccagggcagtgccttgagacactgtttggagatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgta

SEQ ID NO: 115326 - DNA, 1151 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000521583
  CDS Start-End: 445-1005
gttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacatataagaaagaaaaagtcaacaataatacatgtgttgcttgagctaaaagacataggagaacagacaacacatacccattacatttctaggaaatacgagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactga

SEQ ID NO: 115327 - DNA, 912 bp, Homo sapiens
  Payload ID: 2505
  Gene Symbol: CNOT8
  Gene Name: CCR4-NOT transcription complex, subunit 8
  ENST ID: ENST00000520472
  CDS Start-End: 515-912
atggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacac

SEQ ID NO: 115328 - DNA, 2708 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000517876
  CDS Start-End: 477-1355
gaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggagcagatccggggtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggca

SEQ ID NO: 115329 - DNA, 945 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000519404
  CDS Start-End: 190-906
gtagagggaaaagagctccgggccaggggctgccgtcgccgccgtcggggagtcagcccgccagcccgccagctcgtcagcccgccagccagcgcttcgcgggccctgtcggtcccgatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggacacagaatttccaggtgttgtggtgcgaccaattggtgaatttcgtagttccatagattaccaatatcagcttctgcggtgcaatgttgaccttttaaaaattatccagctgggccttacattcacaaatgagaagggagagtatccttctggaatcaatacttggcagttcaatttcaaatttaaccttactggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtg

SEQ ID NO: 115330 - DNA, 1158 bp, Homo sapiens
  Payload ID: 2505
  Gene Symbol: CNOT8
  Gene Name: CCR4-NOT transcription complex, subunit 8
  Uniprot ID: Q9UFF9
  ENST ID: ENST00000521450
  CDS Start-End: 165-725
agagagcaggcgagtcgggcggatcgggagcagatccggggtagagggaaaagagctccgggccaggggctgccgtcgccgccgtcggggagtcagcccgccagcccgccagctcgtcagcccgccagccagcgcttcgcgggccctgtcggtcccgagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaagggaggtcttcaggaagttgctgatcagttggatttgcagaggattggaaggcagcaccaggcaggctcagactcactgctgacaggaatggctttctttaggatgaaagagttgttttttgaggacagcattgatgatgccaagtactgtgggcggctctatggcttaggcacaggagtggcccagaagcagaatgaggatgtggactctgcccaggagaagatgagcatcctggcgattatcaacaacatgcagcagtgatggcgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttcca

SEQ ID NO: 115331 - DNA, 2885 bp, Homo sapiens
  Payload ID: 2506
  Gene Symbol: CCZ1B
  Gene Name: CCZ1 homolog B, vacuolar protein trafficking and biogenesis associated
  Uniprot ID: P86790
  ENST ID: ENST00000316731
  CDS Start-End: 574-2022
caacaggctgggcggtggtgtctcacgcctgtaatcggagcactttgggaggccgaagtgggagaccatttgaggccaggagttcgagagcagcctgggcaacacagaccccacctctacaaaaaaataaaactggccttggtggcgcgcgcctgtaatcctagctacttgggaggctgaggcagggggattgcttgagtgtcggacgttgaggctgcagtgagctgagatcgcgccactacactccagcctggatgacaaactgagaccctatcagaaaaaacaacaacaacaaaaaaacagtgcccgctcggtttttcctgaaacgcgcagccctcgcctgtagccaggagaaaactccgcgagccagcaaaacacaaactcggccaggaaacagacaacaaggccacccgggggtgcctgaagaggacgctgcgaggcggattctttttccgggcctgcggcgagtgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctccttgagcactgtgatgtccacctcatagtcatgtctcttggcctcttcctctctcaagataaagatgttcagcct

SEQ ID NO: 115332 - DNA, 571 bp, Homo sapiens
  Payload ID: 2506
  Gene Symbol: CCZ1B
  Gene Name: CCZ1 homolog B, vacuolar protein trafficking and biogenesis associated
  ENST ID: ENST00000411858
  CDS Start-End: 47-283
ctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcgggagtggattagaacaagatgacatgagaattttatacaaataccttaccacctcccttttcccaaggcacatcgaacctgagttagcaggaagggat

SEQ ID NO: 115333 - DNA, 2211 bp, Homo sapiens
  Payload ID: 2506
  Gene Symbol: CCZ1B
  Gene Name: CCZ1 homolog B, vacuolar protein trafficking and biogenesis associated
  ENST ID: ENST00000626257
  CDS Start-End: 574-810
caacaggctgggcggtggtgtctcacgcctgtaatcggagcactttgggaggccgaagtgggagaccatttgaggccaggagttcgagagcagcctgggcaacacagaccccacctctacaaaaaaataaaactggccttggtggcgcgcgcctgtaatcctagctacttgggaggctgaggcagggggattgcttgagtgtcggacgttgaggctgcagtgagctgagatcgcgccactacactccagcctggatgacaaactgagaccctatcagaaaaaacaacaacaacaaaaaaacagtgcccgctcggtttttcctgaaacgcgcagccctcgcctgtagccaggagaaaactccgcgagccagcaaaacacaaactcggccaggaaacagacaacaaggccacccgggggtgcctgaagaggacgctgcgaggcggattctttttccgggcctgcggcgagtgcttccggggcggtggcgacggaggcggaagtgcggtgttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctcccttttcccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtctgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcagatttcgactcggtctgctgatctgaggtttttagattttaaatatttatgtggaattaattaaaggtagttggctatatcgctatcatttcattcttttgacattatttgaatattttactggaaaataagactaataaattgttaaaagttttt

SEQ ID NO: 115334 - DNA, 1802 bp, Homo sapiens
  Payload ID: 2507
  Gene Symbol: CCZ1
  Gene Name: CCZ1 homolog, vacuolar protein trafficking and biogenesis associated
  Uniprot ID: P86791
  ENST ID: ENST00000325974
  CDS Start-End: 67-1515
ttttagccggtggctgctgtctctgggcgggccgtgggaggctcccgaggtgggggccggggcgggatggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaa

SEQ ID NO: 115335 - DNA, 2218 bp, Homo sapiens
  Payload ID: 2507
  Gene Symbol: CCZ1
  Gene Name: CCZ1 homolog, vacuolar protein trafficking and biogenesis associated
  ENST ID: ENST00000628813
  CDS Start-End: 1-237
atggctgcagcggcggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctccttgagcactgtgatgtccacctcatagtcatgtctcttggcctcttcctctctcaagatgaagatgttcagcct

SEQ ID NO: 115336 - DNA, 3283 bp, Homo sapiens
  Payload ID: 2508
  Gene Symbol: CD101
  Gene Name: CD101 molecule
  Uniprot ID: Q93033
  ENST ID: ENST00000256652
  CDS Start-End: 69-3134
agcatttgtcactcaacctctgaatgttagtgacactattgggacgaaaaaggactgtgctggcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcatgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaaggtgggggctttttaattgggctaaccagggtgtgaatgaatcctggttctgtcctcaactatgtctgcggccttgggcaagttacctaggaatcagagggagcattcactgagtgc

SEQ ID NO: 115337 - DNA, 3324 bp, Homo sapiens
  Payload ID: 2508
  Gene Symbol: CD101
  Gene Name: CD101 molecule
  Uniprot ID: Q93033
  ENST ID: ENST00000369470
  CDS Start-End: 7-3072
gcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcatgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaagtgatgttaaccaacacctttgacctgtcctgtgtcgtgagggccggttactctgacctcaaggtgccactcactgtgacgtggcagttccagccagctagctctcacatcttccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcac

SEQ ID NO: 115338 - DNA, 9130 bp, Homo sapiens
  Payload ID: 2509
  Gene Symbol: CD109
  Gene Name: CD109 molecule
  Uniprot ID: Q6YHK3
  ENST ID: ENST00000287097
  CDS Start-End: 113-4450
ctaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctgtctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaatttttaaaaatgctcttattttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgtctcaaaaaacaaaaaacaaaaaagtcaccttgtaactcatctctttttattgtaagtttattaaaaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtactttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacgtggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatcta

SEQ ID NO: 115339 - DNA, 9401 bp, Homo sapiens
  Payload ID: 2509
  Gene Symbol: CD109
  Gene Name: CD109 molecule
  Uniprot ID: Q6YHK3
  ENST ID: ENST00000437994
  CDS Start-End: 432-4718
atagttgctatgaatttctcctcacaaggatgggcctgtttactcaccctgggcatcgttggtagagcgctagtgtaaacagcctgaggaacccggtgggccggggaagtgggcgcgctctgttctccgcggccagctgggacgccgggccaggtggggccgcctgcgtttagcaactgctttctcaccccctggatttgcgatgtttgccacagcagcgagaagcgccattgtaatggggatgggaggggtggagcctccaagtcctgtctcaatttagatctctcactctgctgttaggcgcgcccatttcagattactaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggctcttttaagacacttactcttccatcactacctctgaacagtgcagatgagatttatgagctacgtgtaaccggacgtacccaggatgagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaaggaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctgtctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaatttttaaaaatgctcttattttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgtctcaaaaaacaaaaaacaaaaaagtcaccttgtaactcatctctttttattgtaagtttattaaaaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtactttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacgtggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctattt

SEQ ID NO: 115340 - DNA, 9221 bp, Homo sapiens
  Payload ID: 2509
  Gene Symbol: CD109
  Gene Name: CD109 molecule
  Uniprot ID: Q6YHK3
  ENST ID: ENST00000422508
  CDS Start-End: 432-4538
atagttgctatgaatttctcctcacaaggatgggcctgtttactcaccctgggcatcgttggtagagcgctagtgtaaacagcctgaggaacccggtgggccggggaagtgggcgcgctctgttctccgcggccagctgggacgccgggccaggtggggccgcctgcgtttagcaactgctttctcaccccctggatttgcgatgtttgccacagcagcgagaagcgccattgtaatggggatgggaggggtggagcctccaagtcctgtctcaatttagatctctcactctgctgttaggcgcgcccatttcagattactaaactcgaattaagagggaaaaaaaatcagggaggaggtggcaagccacaccccacggtgcccgcgaacttccccggcagcggactgtagcccaggcagacgccgtcgagatgcagggcccaccgctcctgaccgccgcccacctcctctgcgtgtgcaccgccgcgctggccgtggctcccgggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggctcttttaagacacttactcttccatcagaccccaaatcaaatttgatccaacagtggttgtcacaacaaagtgatcttggagtcatttccaaaacttttcagctatcttcccatccaatacttggtgactggtctattcaagttcaagtgaatgaccagacatactatcaatcatttcaggtttcagaatatgtattaccaaaatttgaagtgactttgcagacaccattatattgttctatgaattctaagcatttaaatggtaccatcacggcaaagtatacatatgggaagccagtgaaaggagacgtaacgcttacatttttacctttatccttttggggaaagaagaaaaatattacaaaaacatttaagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtatttcaagaaatgtaagcactaatgtgttcttcaagcaacatgattacatcattgagttttttgattatactactgtcttgaagccatctctcaacttcacagccactgtgaaggtaactcgtgctgatggcaaccaactgactcttgaagaaagaagaaataatgtagtcataacagtgacacagagaaactatactgagtactggagcggatctaacagtggaaatcagaaaatggaagctgttcagaaaataaattatactgtcccccaaagtggaacttttaagattgaattcccaatcctggaggattccagtgagctacagttgaaggcctatttccttggtagtaaaagtagcatggcagttcatagtctgtttaagtctcctagtaagacatacatccaactaaaaacaagagatgaaaatataaaggtgggatcgccttttgagttggtggttagtggcaacaaacgattgaaggagttaagctatatggtagtatccaggggacagttggtggctgtaggaaaacaaaattcaacaatgttctctttaacaccagaaaattcttggactccaaaagcctgtgtaattgtgtattatattgaagatgatggggaaattataagtgatgttctaaaaattcctgttcagcttgtttttaaaaataagataaagctatattggagtaaagtgaaagctgaaccatctgagaaagtctctcttaggatctctgtgacacagcctgactccatagttgggattgtagctgttgacaaaagtgtgaatctgatgaatgcctctaatgatattacaatggaaaatgtggtccatgagttggaactttataacacaggatattatttaggcatgttcatgaattcttttgcagtctttcaggaatgtggactctgggtattgacagatgcaaacctcacgaaggattatattgatggtgtttatgacaatgcagaatatgctgagaggtttatggaggaaaatgaaggacatattgtagatattcatgacttttctttgggtagcagtccacatgtccgaaagcattttccagagacttggatttggctagacaccaacatgggttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcacccactgcttctgatgctgtcacccagatgattttagtaaaggctgaaggaatagaaaaatcatattcacaatccatcttattagacttgactgacaataggctacagagtaccctgaaaactttgagtttctcatttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatacagaaaggacaaatatccaagtgaccgtgacggggcctagctcaccaagtcctgtaaagtttctgattgacacacacaaccgcttactccttcagacagcagagcttgctgtggtacagccaacggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccaacccaccccatgcccagtggtctcagtagatacttcttaactggaaattctttcttttcagaatctaggtggtgaattttttttaagtggcacggtctttttctgcttgaaatctgatcacaccccccagccattgccctccctctctttttcctctgtagagaaatgtgaggggcagtacatttactgtgcttttcacaccatctcagaggttgaggagcatactgaaaattgccctggggggtgctgggtgtgctgtctccttcccacatcctcagccccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaatttttaaaaatgctcttattttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgtctcaaaaaacaaaaaacaaaaaagtcaccttgtaactcatctctttttattgtaagtttattaaaaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtagccaaacaattctaggacagaataacatttttatatttggttccaccatcttattacatttagttatagttttaaaaaagaaattcaagcccattaaaatatgtctggtcaatgaaatgcttccttttattgtgttgtgctattgtactttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacgtggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctattt

SEQ ID NO: 115341 - DNA, 1886 bp, Homo sapiens
  Payload ID: 2510
  Gene Symbol: CD14
  Gene Name: CD14 molecule
  Uniprot ID: P08571
  ENST ID: ENST00000302014
  CDS Start-End: 631-1758
aattctaccccccttggtgccaacagatgaggttcacaatctcttccacaaaacatgcagttaaatatctgaggatattcagggacttggatttggtggcaggagatcaacataaaccaagacaaggaagaagtcaaagaaatgaatcaagtagattctctgggatataaggtagggggattggggggttggatagtgcagagtatggtactggcctaaggcactgaggatcatccttttcccacacccaccagagaaggcttaggctcccgagtcaacagggcattcaccgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacgggtc

SEQ ID NO: 115342 - DNA, 1648 bp, Homo sapiens
  Payload ID: 2510
  Gene Symbol: CD14
  Gene Name: CD14 molecule
  Uniprot ID: P08571
  ENST ID: ENST00000401743
  CDS Start-End: 393-1520
aattctaccccccttggtgccaacagatgaggttcacaatctcttccacaaaacatgcagttaaatatctgaggatattcagggacttggatttggtggcaggagatcaacataaaccaagacaaggaagaagtcaaagaaatgaatcaagtagattctctgggatataaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacgggtc

SEQ ID NO: 115343 - DNA, 556 bp, Homo sapiens
  Payload ID: 2510
  Gene Symbol: CD14
  Gene Name: CD14 molecule
  ENST ID: ENST00000512545
  CDS Start-End: 392-556
attctaccccccttggtgccaacagatgaggttcacaatctcttccacaaaacatgcagttaaatatctgaggatattcagggacttggatttggtggcaggagatcaacataaaccaagacaaggaagaagtcaaagaaatgaatcaagtagattctctgggatataaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagta

SEQ ID NO: 115344 - DNA, 882 bp, Homo sapiens
  Payload ID: 2510
  Gene Symbol: CD14
  Gene Name: CD14 molecule
  ENST ID: ENST00000498971
  CDS Start-End: 243-882
aaacatgcagttaaatatctgaggatattcagggacttggatttggtggcaggagatcaacataaaccaagacaaggaagaagtcaaagaaatgaatcaagtagattctctgggatataagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatgg

SEQ ID NO: 115345 - DNA, 485 bp, Homo sapiens
  Payload ID: 2510
  Gene Symbol: CD14
  Gene Name: CD14 molecule
  ENST ID: ENST00000519715
  CDS Start-End: 243-485
aggttcacaatctcttccacaaaacatgcagttaaatatctgaggatattcagggacttggatttggtggcaggagatcaacataaaccaagacaaggaagaagtcaaagaaatgaatcaaaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcag

SEQ ID NO: 115346 - DNA, 1548 bp, Homo sapiens
  Payload ID: 2511
  Gene Symbol: CD151
  Gene Name: CD151 molecule (Raph blood group)
  Uniprot ID: P48509
  ENST ID: ENST00000322008
  CDS Start-End: 145-906
attctcagcgctgggagccgccgcccccgcagctgctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcagatgg

SEQ ID NO: 115347 - DNA, 1648 bp, Homo sapiens
  Payload ID: 2511
  Gene Symbol: CD151
  Gene Name: CD151 molecule (Raph blood group)
  Uniprot ID: P48509
  ENST ID: ENST00000397420
  CDS Start-End: 250-1011
cgcgggttcagacctgccgagcgcccgccgccgcgggaggggcttgaggccggggcggggccggggcggggcggggcggggcgtccccctcgtaggctccgggccgcgcattctcagcgctgggagccgccgcccccgcagctgctgccgccgccgccagggcccggactcggacgcgtgcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagca

SEQ ID NO: 115348 - DNA, 1486 bp, Homo sapiens
  Payload ID: 2511
  Gene Symbol: CD151
  Gene Name: CD151 molecule (Raph blood group)
  Uniprot ID: P48509
  ENST ID: ENST00000397421
  CDS Start-End: 83-844
attctcagcgctgggagccgccgcccccgcagctgctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcagatgg

SEQ ID NO: 115349 - DNA, 793 bp, Homo sapiens
  Payload ID: 2511
  Gene Symbol: CD151
  Gene Name: CD151 molecule (Raph blood group)
  ENST ID: ENST00000524748
  CDS Start-End: 253-793
cgccgccagggcccggactcggacgcgtgcctagagtcctggggagcttctgtccacctgtcctgcagaggagtcgtttccagcccggctggtgagtgctggccagggtggggcagagcaggcggggcggcgaaagtccagacctggctgtgctgtctggaaacgtggcccagggcgctcagctgctgtctgcaccccacgccctccctggcttccccatgctcacagcttgcccactgctgcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcc

SEQ ID NO: 115350 - DNA, 561 bp, Homo sapiens
  Payload ID: 2511
  Gene Symbol: CD151
  Gene Name: CD151 molecule (Raph blood group)
  ENST ID: ENST00000525333
  CDS Start-End: 323-561
gctgccgccgccgccagggcccggactcggacgcgtggtagcctagagtcctggggagcttctgtccacctgtcctgcagaggagtcgtttccagcccggctggtgagtgctggccagggtggggcagagcaggcggggcggcgaaagtccagacctggctgtgctgtctggaaacgtggcccagggcgctcagctgctgtctgcaccccacgccctccctggcttccccatgctcacagcttgcccactgctgcaggtcgggcgggcacggggcatctggggaggggcatagcctgtctgtgctgccccctcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctg

SEQ ID NO: 115351 - DNA, 608 bp, Homo sapiens
  Payload ID: 2511
  Gene Symbol: CD151
  Gene Name: CD151 molecule (Raph blood group)
  ENST ID: ENST00000529810
  CDS Start-End: 74-608
gctgggagccgccgcccccgcagctgctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaagg

SEQ ID NO: 115352 - DNA, 1407 bp, Homo sapiens
  Payload ID: 2511
  Gene Symbol: CD151
  Gene Name: CD151 molecule (Raph blood group)
  Uniprot ID: P48509
  ENST ID: ENST00000530726
  CDS Start-End: 84-845
gactcggacgcgtgcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcaga

SEQ ID NO: 115353 - DNA, 1369 bp, Homo sapiens
  Payload ID: 2511
  Gene Symbol: CD151
  Gene Name: CD151 molecule (Raph blood group)
  ENST ID: ENST00000528011
  CDS Start-End: 8-763
ccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccac

SEQ ID NO: 115354 - DNA, 545 bp, Homo sapiens
  Payload ID: 2511
  Gene Symbol: CD151
  Gene Name: CD151 molecule (Raph blood group)
  ENST ID: ENST00000528867
  CDS Start-End: 276-545
attctccccaccccggccaggatgaaggaagggctgccctttaacagaccgtaaacaggcctggagagcttaggaaggggctgagctggggcctgtctgagcccctacccctctgctgtctgagtggcctcctccgcccttactgcaggcccataggctcctgccagcctgtgacgtgcggccccgggaatgccgtggggagcgggcaggctggcatgagctcaccggaggtacccgctagggcttcctcccccggccgctagcagggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctg

SEQ ID NO: 115355 - DNA, 648 bp, Homo sapiens
  Payload ID: 2511
  Gene Symbol: CD151
  Gene Name: CD151 molecule (Raph blood group)
  ENST ID: ENST00000530320
  CDS Start-End: 139-648
caccaggggtctgtcctggctgtcagggctcctgagtcgctaggaagtgacacgtcctgttcccacaggggctcattcacaggcctcccaggacagtggctggctctgccccgacttctgggctggcttggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatc

SEQ ID NO: 115356 - DNA, 713 bp, Homo sapiens
  Payload ID: 2511
  Gene Symbol: CD151
  Gene Name: CD151 molecule (Raph blood group)
  ENST ID: ENST00000526439
  CDS Start-End: 520-713
ggctggttgtgaactcccgacctcaagtgattgcacctgccttggcctcccaaagtgctggcattataggcatgagacaccgcacctggactcctttcctctactttctttgggttaatttgctagtctctttttattatttatttatttattttgagatggagtctcactctgtcgcccaggctggagtgcagtggcaccatctcggctcactgcaagcttcgcctcccgggttcacgccattctcctgcctcagcctcccaagtagctgggactacaggcgcccgccaccacgcccggctaattttttgtatttctagtacagacggggtttcaccgtgttagccaggatggtcttgatctcctgaccttgtgatctgcctgccttggccccccaaagtgctgggattacaggcgtgagccaccgcgcctggccctgtgtcccctcctatccgtctcccagtcaggggcccggtgctgtggccccgctgacccctcccctgcctcctcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggt

SEQ ID NO: 115357 - DNA, 771 bp, Homo sapiens
  Payload ID: 2511
  Gene Symbol: CD151
  Gene Name: CD151 molecule (Raph blood group)
  ENST ID: ENST00000526693
  CDS Start-End: 244-771
ccgccgcccccgcagctgctgccgccgccgccagggcccggactcggacgcgtgcctagagtcctggggagcttctgtccacctgtcctgcagaggagtcgtttccagcccggctggcccataggctcctgccagcctgtgacgtgcggccccgggaatgccgtggggagcgggcaggctggcatgagctcaccggaggtacccgctagggcttcctcccccggccgctagcagggccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggt

SEQ ID NO: 115358 - DNA, 565 bp, Homo sapiens
  Payload ID: 2511
  Gene Symbol: CD151
  Gene Name: CD151 molecule (Raph blood group)
  ENST ID: ENST00000525718
  CDS Start-End: 290-565
tgaggccggggcggggccggggcggggcggggcggggcgtccccctcgtaggctccgggccgcgcattctcagcgctgggagccgccgcccccgcagctgctgccgccgccgccagggcccggactcggacgcgtggtaggctgtagctgccgctgtttgtgggggaagggccagtgatgggtctggagcgaaggccaagagtggggcacctgggggaagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctg

SEQ ID NO: 115359 - DNA, 797 bp, Homo sapiens
  Payload ID: 2511
  Gene Symbol: CD151
  Gene Name: CD151 molecule (Raph blood group)
  ENST ID: ENST00000527341
  CDS Start-End: 257-797
cgccgccagggcccggactcggacgcgtggtagcctagagtcctggggagcttctgtccacctgtcctgcagaggagtcgtttccagcccggctggtgagtgctggccagggtggggcagagcaggcggggcggcgaaagtccagacctggctgtgctgtctggaaacgtggcccagggcgctcagctgctgtctgcaccccacgccctccctggcttccccatgctcacagcttgcccactgctgcagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcc

SEQ ID NO: 115360 - DNA, 1425 bp, Homo sapiens
  Payload ID: 2512
  Gene Symbol: CD160
  Gene Name: CD160 molecule
  Uniprot ID: O95971
  ENST ID: ENST00000235933
  CDS Start-End: 85-630
ctgtgcttttaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagtatttggagtcttttcttttctcctaaatccacaaactctcttctttctctttggacagatgacctcttgtcatagttaagcagagagtgggcaggatattcctgataggaggaactacatgaataaaggggtaag

SEQ ID NO: 115361 - DNA, 1424 bp, Homo sapiens
  Payload ID: 2512
  Gene Symbol: CD160
  Gene Name: CD160 molecule
  Uniprot ID: O95971
  ENST ID: ENST00000369288
  CDS Start-End: 219-764
ccccagtctgagaacaagaaagaagaacttctgtctcgagggtctcactgtcaaccaggccagagtgcagtgaagatcatacctcactacatccgtgaactcccgggctcctcccacctaagtctcttgagtagctgggacttcaggagactgaagccaaggataccagcagagccaacatttgcttcaagttcctgggcctgctgacagcgtgcaggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 115362 - DNA, 705 bp, Homo sapiens
  Payload ID: 2512
  Gene Symbol: CD160
  Gene Name: CD160 molecule
  ENST ID: ENST00000401557
  CDS Start-End: 1-705
atgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactga

SEQ ID NO: 115363 - DNA, 219 bp, Homo sapiens
  Payload ID: 2512
  Gene Symbol: CD160
  Gene Name: CD160 molecule
  ENST ID: ENST00000584442
  CDS Start-End: 1-219
atgctgttggaacccggcagaggctgctgtgccctggccatcctgctggcaattgtggacatccagtctggtgagacagggaactacacagtgacgggattgaaacaaagacaacaccttgagttcagccataatgaaggcactctcagttcaggcttcctacaagaaaaggtctgggtaatgctggtcaccagccttgtggcccttcaagctttgtaa

SEQ ID NO: 115364 - DNA, 3388 bp, Homo sapiens
  Payload ID: 2512
  Gene Symbol: CD160
  Gene Name: CD160 molecule
  ENST ID: ENST00000616463
  CDS Start-End: 159-536
aacaagatgcaaggacaatctgaggactgagagccatttcaacgtgagcccccagtctgagaacaagaaagaagaacttctgtctcgagactgaagccaaggataccagcagagccaacatttgcttcaagttcctgggcctgctgacagcgtgcaggatgctgttggaacccggcagaggctgctgtgccctggccatcctgctggcaattgtggacatccagtctggtgagacagggaactacacagtgacgggattgaaacaaagacaacaccttgagttcagccataatgaaggcactctcagttcaggcttcctacaagaaaaggtctgggtaatgctggtcaccagccttgtggcccttcaaggtatgtccaaaagagccgtaagcaccccaagcaatgagggtgctattatatttctgccaccttggttattctccaggaggagaaggttggaaaggatgtccagggggagagaaaaatgttactcaagccctggctatccacaggaaagttcaaaccagtttcactgatccaaaggcactaaggaggaagacagataaatcagacttttcaatgggtaggaggtaagactcattaggaatgaaggcctgtgagagaggcaagttagtacaactacctctactcactgcatgaacagagggctacaagttgaagcaacagattttcagctattagaggaagaaaaggcaagagacagacttggtttggagatgggttttgaacaatgcggctcctcagcaaaggctgatggccagattgagtatattaaacacatgtagctgagtcctctgaaaaccatttaccaatatagattagcgttttccctattagataacaaaaagtgaaacttccaataatttgtcataacgtttttgcataacaagcaactgattcaggtttttgcctggccttggcattcttaactccattttatttaggcattcctcaaatcaataactaccactgttttgaatggcatcagaatgtaagctctatatatatgtaaggactttgtcttctttaccccaacgaaaagtcccacacatatggcaggctcttaataaatttgttaaaaaacctgtatgatgaatcagatgctttacacatgatgattctaaccttatacaacccttgcaagcaaacatcccctggttactcatcaggaaacagacacaaggaagttaaatagggcctggtgcggtggctcacgcctgtaatcccagcactttgggaggccaaggcaggcagatcctttgagcctaggagtttgaggccagtctgggcaacatggcaaaaccccaactatacaaaaaaatacaaaaattaggcatggtggcacacaactgtagtcccaagctaaggcatgaggatcacctgagcccaggctggttgaggttgcagtgagccatgatcatgccactgtactccagcctgggtgacagggtgagacactttctcaaaggaaaaaaaaaaaaaaaaagagttaattgttgcccgtcacagcaattaatacagatccttctcactctaaaaccttacactcagtaatgatctactatatgcaaagcacctcttacatccttcaccaccccattcattctgagattgactcctcccctttccagaaacaggaccacctaaacattccctattccagtcccttatttgcaagtcatcaaaagaaaacagagatttcaaaaagaaaacagagaccttatctgtaatccttggtaaggatcttccaaatttaagcctatgccagttttcaggaggaaacatgaatatgaaacagtctgacctttagacataattttttgttgactttaaattcccttggttaggccactgtaaccagtaaaataaattttattttagaataaaaattataaaggggaaattgagtctagccatacaacctactactagttactatctttgattcccaagtcatcctagagcaaaaaaaaaaaaaaaaaaatcatctctggcctttttttccttttccactcaggtgaagagaatgagcttttgaatccaattttttgttttctcctatattcaattcaagtagctttaaagttaaccaaaggaaaaaaccaaagctcaatatttgattaaacgagaaaatatacactacttagaagctttcttttctttatccttcttccccaactcaaggcttagtagaattattgaaagaggtagtattcagtagaatagtacacatgctttttcaggtccagaaacaccacataggtcaagttatcatgcttacatgtggggaaaaggaggagggagtttcctggacctctgtgcctctctcagctcatgaactagtttcagtgaatatccttgtcttaccactgtgccaacaattcagagctatacgtggaaaacctaccttcaactttttgagtggcatctattgcttctttgattgttccttccagcaaggagcgatcaaaggctagcccccttcccactcccaccagaatcagatttgctcaagattacaaccctaatttagtaataagatgcaatacataaaatagttcccactttccttttccaatccctttacagtcatgagggcctatcacgcacgcatctcaggacaggtgagacttcattatatcaggtattttgttgctattctaagttataaggcagtaatacaaactttctttccacagctttgtaagccttgtgccaaaagaaacttttaaaacagctacagcaagatgagtctgactatggcttagtatctttctcattacaataggcacagagaagaatgcaacagggcacaggggaagagatgctaaatataccaagaatctgtggaaatataagctggggcaaatcagtgtaatccttgactttgctcctcaccatcagggcaaacttgccttcttccctcctaagctccagtaaataaacagaacagctttcaccaaagtgggtagtatagtcctcaaatatcggataaatatatgcgtttttgtaccccagaaaaacttttcctccctcttcatcaacatagtaaaataagtcaaacaaaatgagaacaccaaattttgggggaataaatttttatttaacactgcaaaggaaagagagagaaaacaagcaaagataggtaggacagaaaggaagacagccagatccagtgattgacttggcatgaaaatgagaaaatgcagacagacctcaacattcaacaacatccatacagcactgctggaggaagaggaagatttgtgcagaccaagagcaccacagactacaactgcccagcttcatctaaatacttgttaacctctttggtcatttctctttttaaataaatgcccatagcagt

SEQ ID NO: 115365 - DNA, 4268 bp, Homo sapiens
  Payload ID: 2513
  Gene Symbol: CD163
  Gene Name: CD163 molecule
  Uniprot ID: Q86VB7
  ENST ID: ENST00000359156
  CDS Start-End: 204-3674
attgaagaaaacatgagtatgaaatggaacctcagctctttcaatgacttccctttttgagttgactccgcctccatatgtagccttttcattttcatgaaagtgaagtgatttttagaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcacaaa

SEQ ID NO: 115366 - DNA, 3800 bp, Homo sapiens
  Payload ID: 2513
  Gene Symbol: CD163
  Gene Name: CD163 molecule
  ENST ID: ENST00000396620
  CDS Start-End: 87-3551
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagtaagacccagaaaacatctttaattggttctcatactgtgaaagggacagggttagggagtcatagctgtctttttctaaagccctgtctccttccaggatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgtta

SEQ ID NO: 115367 - DNA, 3701 bp, Homo sapiens
  Payload ID: 2513
  Gene Symbol: CD163
  Gene Name: CD163 molecule
  Uniprot ID: Q86VB7
  ENST ID: ENST00000432237
  CDS Start-End: 87-3452
gaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgtta

SEQ ID NO: 115368 - DNA, 640 bp, Homo sapiens
  Payload ID: 2513
  Gene Symbol: CD163
  Gene Name: CD163 molecule
  ENST ID: ENST00000537626
  CDS Start-End: 1-413
ctggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgtta

SEQ ID NO: 115369 - DNA, 3590 bp, Homo sapiens
  Payload ID: 2513
  Gene Symbol: CD163
  Gene Name: CD163 molecule
  ENST ID: ENST00000541972
  CDS Start-End: 12-3341
actgaaactatatgagcctggacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgtta

SEQ ID NO: 115370 - DNA, 606 bp, Homo sapiens
  Payload ID: 2513
  Gene Symbol: CD163
  Gene Name: CD163 molecule
  ENST ID: ENST00000542280
  CDS Start-End: 1-375
gacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattga

SEQ ID NO: 115371 - DNA, 4615 bp, Homo sapiens
  Payload ID: 2514
  Gene Symbol: CD163L1
  Gene Name: CD163 molecule-like 1
  Uniprot ID: Q9NR16
  ENST ID: ENST00000313599
  CDS Start-End: 59-4420
gattatatataagaggacccaggagttacatcaggactcaggaagagatagacccataatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttctttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttatggtgaagccaatctgggtttgaggctagtggatggaaacaactcctgttcagggagagtggaggtgaaattccaagaaaggtggggaactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtttgtaaacaattgggatgtggaaagcctttgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaactgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaatggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgttaaa

SEQ ID NO: 115372 - DNA, 4603 bp, Homo sapiens
  Payload ID: 2514
  Gene Symbol: CD163L1
  Gene Name: CD163 molecule-like 1
  Uniprot ID: Q9NR16
  ENST ID: ENST00000416109
  CDS Start-End: 20-4411
aggaagagatagacccataatgatgctgcctcaaaactcgtggcatattgattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttctttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttatggtaagagtctaactagagtaggaaggcaaggtgaagccaatctgggtttgaggctagtggatggaaacaactcctgttcagggagagtggaggtgaaattccaagaaaggtggggaactatatgtgatgatgggtggaacttgaatactgctgccgtggtgtgcaggcaactaggatgtccatcttcttttatttcttctggagttgttaatagccctgctgtattgcgccccatttggctggatgacattttatgccaggggaatgagttggcactctggaattgcagacatcgtggatggggaaatcatgactgcagtcacaatgaggatgtcacattaacttgttatgatagtagtgatcttgaactaaggcttgtaggtggaactaaccgctgtatggggagagtagagctgaaaatccaaggaaggtgggggaccgtatgccaccataagtggaacaatgctgcagctgatgtcgtatgcaagcagttgggatgtggaaccgcacttcacttcgctggcttgcctcatttgcagtcagggtctgatgttgtatggcttgatggtgtctcctgctccggtaatgaatcttttctttgggactgcagacattccggaaccgtcaattttgactgtcttcatcaaaacgatgtgtctgtgatctgctcagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctgataaggcagatctggacctaaggcttgtcggggctcatagcccctgttatgggagattggaggtgaaataccaaggagagtgggggactgtgtgtcatgacagatggagcacaaggaatgcagctgttgtttgtaaacaattgggatgtggaaagcctttgcatgtgtttggtatgacctattttaaagaagcatcaggacctatttggctggatgacgtttcttgcattggaaatgagtcaaatatctgggactgtgaacacagtggatggggaaagcataattgtgtacacagagaggatgtgattgtaacctgctcaggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgtttcctgtgatggagatgagtcagatctctggtcatgcaggaacagtgggtggggaaataatgactgcagtcacagtgaagatgttggagtgatctgttctgatgcatcggatatggagctgaggcttgtgggtggaagcagcaggtgtgctggaaaagttgaggtgaatgtccagggtgccgtgggaattctgtgtgctaatggctggggaatgaacattgctgaagttgtttgcaggcaacttgaatgtgggtctgcaatcagggtctccagagagcctcatttcacagaaagaacattacacatcttaatgtcgaattctggctgcactggaggggaagcctctctctgggattgtatacgatgggagtggaaacagactgcgtgtcatttaaatatggaagcaagtttgatctgctcagcccacaggcagcccaggctggttggagctgatatgccctgctctggacgtgttgaagtgaaacatgcagacacatggcgctctgtctgtgattctgatttctctcttcatgctgccaatgtgctgtgcagagaattaaactgtggagatgccatatctctttctgtgggagatcactttggaaaagggaatggtctaacttgggccgaaaagttccagtgtgaagggagtgaaactcaccttgcattatgccccattgttcaacatccggaagacacttgtatccacagcagagaagttggagttgtctgttcccgatatacagatgtccgacttgtgaatggcaaatcccagtgtgacgggcaagtggagatcaacgtgcttggacactggggctcactgtgtgacacccactgggacccagaagatgcccgtgttctatgcagacagctcagctgtgggactgctctctcaaccacaggaggaaaatatattggagaaagaagtgttcgtgtgtggggacacaggtttcattgcttagggaatgagtcacttctggataactgtcaaatgacagttcttggagcacctccctgtatccatggaaatactgtctctgtgatctgcacaggaagcctgacccagccactgtttccatgcctcgcaaatgtatctgacccatatttgtctgcagttccagagggcagtgctttgatctgcttagaggacaaacggctccgcctagtggatggggacagccgctgtgccgggagagtagagatctatcacgacggcttctggggcaccatctgtgatgacggctgggacctgagcgatgcccacgtggtgtgtcaaaagctgggctgtggagtggccttcaatgccacggtctctgctcactttggggaggggtcagggcccatctggctggatgacctgaactgcacaggaatggagtcccacttgtggcagtgcccttcccgcggctgggggcagcacgactgcaggcacaaggaggacgcaggggtcatctgctcagaattcacagccttgaggctctacagtgaaactgaaacagagagctgtgctgggagattggaagtcttctataacgggacctggggcagcgtcggcaggaggaacatcaccacagccatagcaggcattgtgtgcaggcagctgggctgtggggagaatggagttgtcagcctcgcccctttatctaagacaggctctggtttcatgtgggtggatgacattcagtgtcctaaaacgcatatctccatatggcagtgcctgtctgccccatgggagcgaagaatctccagcccagcagaagagacctggatcacatgtgaagatagaataagagtgcgtggaggagacaccgagtgctctgggagagtggagatctggcacgcaggctcctggggcacagtgtgtgatgactcctgggacctggccgaggcggaagtggtgtgtcagcagctgggctgtggctctgctctggctgccctgagggacgcttcgtttggccagggaactggaaccatctggttggatgacatgcggtgcaaaggaaatgagtcatttctatgggactgtcacgccaaaccctggggacagagtgactgtggacacaaggaagatgctggcgtgaggtgctctggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaataacatttcttgaacaataggagaacagctaaattgataaagactggtgataataaaaattgaattatgtatatcactgtt

SEQ ID NO: 115373 - DNA, 815 bp, Homo sapiens
  Payload ID: 2514
  Gene Symbol: CD163L1
  Gene Name: CD163 molecule-like 1
  ENST ID: ENST00000539726
  CDS Start-End: 1-328
ctcaggacagtcgctgaaatcactgaatgcctcctcaggtcatttagcacttattttatccagtatctttgggctccttctcctggttctgtttattctatttctcacgtggtgccgagttcagaaacaaaaacatctgcccctcagagtttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagaatcttgatatgtgggtgatgttaagccctcctgacccagcaagttgaaaactcaccatgaagagcagcggtcaaaggaactagggaaatcctacagtgtgatcagtttttctgctgcaggtaagcagagagcatccctttgcactgaataggccactgagccgcattactgcttattaattcctcatcattcctgcctccttttatgttctccctaaatgactaggtttgcggggccaggaactttatttcccacaatccctaacaggaagaatctgggctcgcttccaccagagagacttgttcatggaagatacggtttcgcaaggatctttgtacttgtcctgaaaactgctagcctagatattacagcatggtgccctttagcagtggtttcctgggggttttaaaacttcctgatgagggttttgtaagcataattattccctgtagtaaaccactt

SEQ ID NO: 115374 - DNA, 568 bp, Homo sapiens
  Payload ID: 2514
  Gene Symbol: CD163L1
  Gene Name: CD163 molecule-like 1
  ENST ID: ENST00000545926
  CDS Start-End: 1-568
acgtttctctgtgacttcatcctagatggagcagatttggaactgcgactagcagatggaagtaacaattgttcagggagagtagaggtgagaattcatgaacagtggtggacaatatgtgaccagaactggaagaatgaacaagcccttgtggtttgtaagcagctaggatgtccgttcagcgtctttggcagtcgtcgtgctaaacctagtaatgaagctagagacatttggataaacagcatatcttgcactgggaatgagtcagctctctgggactgcacatatgatggaaaagcaaagcgaacatgcttccgaagatcagatgctggagtaatttgttctggtgatgcaacatggggcctgaggctggtgggcggcagcaaccgctgctcgggaagactggaggtgtactttcaaggacggtggggcacagtgtgtgatgacggctggaacagtaaagctgcagctgtggtgtgtagccagctggactgcccatcttctatcattggcatgggtctgggaaacgcttctacaggatatggaaaaatttggctcgatgatgttt

SEQ ID NO: 115375 - DNA, 532 bp, Homo sapiens
  Payload ID: 2514
  Gene Symbol: CD163L1
  Gene Name: CD163 molecule-like 1
  ENST ID: ENST00000543276
  CDS Start-End: 348-532
acactgaaaaggaaaatgggaatttataacccagtgaggaggtctgaaaacattgggccatcatttcaacatgacaacggtgaattggagattttggaagatgctgctgtcatcagaaccttttctctgctgtggtaacttgcatcctgctcctgaattcctgctttctcatcagcagttttaatggaacagatttggagttgaggctggtcaatggagacggtccctgctctgggacagtggaggtgaaattccagggacagtgggggactgtgtgtgatgatgggtggaacactactgcctcaactgtcgtgtgcaaacagcttggatgtccattttctttcgccatgtttcgttttggacaagccgtgactagacatggaaaaatttggcttgatgatgtttcctgttatggaaatgagtcagctctctgggaatgtcaacaccgggaatggggaagccataactgttatcatggagaagatgttggtgtgaactgttatggtgaagccaatctgggtttgaggctagt

SEQ ID NO: 115376 - DNA, 470 bp, Homo sapiens
  Payload ID: 2514
  Gene Symbol: CD163L1
  Gene Name: CD163 molecule-like 1
  ENST ID: ENST00000546182
  CDS Start-End: 1-175
ctcaggacagtcgctgaaatcactgaatgcctcctcaggtcatttagcacttattttatccagtatctttgggctccttctcctggttctgtttattctatttctcacgtggtgccgagttcagaaacaaaaacatctgcccctcagaggtgagagccccactaggattgtataaaattttcaaccagaaggaggggttctctcgaggagaatttattccatgagatggagacctgcctcaagagagaggacccacatgggacaagaacctcagatgacacccccaaccatggttgtgaagatgctagcgacacatcgctgttgggagttcttcctgcctctgaagccacaaaatgactttagacttccagggctcaccagatcaacctctaaatatctttgaaggagacaacaacttttaaatgaataaagaggaagtcaagttgccctatggaaaacttgtccaaata

SEQ ID NO: 115377 - DNA, 2954 bp, Homo sapiens
  Payload ID: 2515
  Gene Symbol: CD164
  Gene Name: CD164 molecule, sialomucin
  Uniprot ID: Q04900
  ENST ID: ENST00000275080
  CDS Start-End: 67-621
ggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaa

SEQ ID NO: 115378 - DNA, 2993 bp, Homo sapiens
  Payload ID: 2515
  Gene Symbol: CD164
  Gene Name: CD164 molecule, sialomucin
  Uniprot ID: Q04900
  ENST ID: ENST00000310786
  CDS Start-End: 67-660
ggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaa

SEQ ID NO: 115379 - DNA, 2936 bp, Homo sapiens
  Payload ID: 2515
  Gene Symbol: CD164
  Gene Name: CD164 molecule, sialomucin
  Uniprot ID: Q04900
  ENST ID: ENST00000324953
  CDS Start-End: 67-603
ggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaa

SEQ ID NO: 115380 - DNA, 3106 bp, Homo sapiens
  Payload ID: 2515
  Gene Symbol: CD164
  Gene Name: CD164 molecule, sialomucin
  ENST ID: ENST00000368961
  CDS Start-End: 182-625
atcgtccgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggcccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaatt

SEQ ID NO: 115381 - DNA, 2414 bp, Homo sapiens
  Payload ID: 2515
  Gene Symbol: CD164
  Gene Name: CD164 molecule, sialomucin
  Uniprot ID: Q04900
  ENST ID: ENST00000413644
  CDS Start-End: 80-649
gcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttggaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctggatgaatagactgtgctttttctttttctctcccttccttcttggtttcccatagtataataagcatgcatactttaacttctatagttttctcctttagagggtcgtcttcagttttagaggtttacttctcccttgcctttgactcattggactagtgcagaggctttaagtagtttaaaatgggcttttgcttttctaggtcattaacgttttttatttagtttctttagccaatagtggctgagtttcgcacttgattttcaatattttatagtaagaaatgacaaactgctttgtttcatttcataaacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaa

SEQ ID NO: 115382 - DNA, 1402 bp, Homo sapiens
  Payload ID: 2515
  Gene Symbol: CD164
  Gene Name: CD164 molecule, sialomucin
  ENST ID: ENST00000504373
  CDS Start-End: 125-616
gttcgtgtctcagacttgagtctgagaaggtcgcttgagatttaattacattggttttgcagataggaatagaatgtagctgacgtttgagcacgtagttagtgaaaacttcacacttcaaagtatgcgaaaaggaagaaaagtacccatgtatgtaccgggtgttttgcgtacgtatcctaaggctaaactggaagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactg

SEQ ID NO: 115383 - DNA, 964 bp, Homo sapiens
  Payload ID: 2515
  Gene Symbol: CD164
  Gene Name: CD164 molecule, sialomucin
  Uniprot ID: Q04900
  ENST ID: ENST00000512821
  CDS Start-End: 33-506
gctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaag

SEQ ID NO: 115384 - DNA, 1457 bp, Homo sapiens
  Payload ID: 2516
  Gene Symbol: CD164L2
  Gene Name: CD164 sialomucin-like 2
  Uniprot ID: Q6UWJ8
  ENST ID: ENST00000374027
  CDS Start-End: 65-586
acgcgcccggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacggagcgcgcaatctctccagctgcgtgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctgtgagtacctggccagcagcaagtacctgagtcccagcttacctcctggttcctgccccaccgttccccttcagtacccagggtgctgtcttctccatgggcaagccctcaggacggtgacagcgtgctccatgtgagccacaccccttttgtctcctccagttggggtgtttcctttgtcagatgttggctgggaccaggactcagcctgggccagtctaggagcccagctgagccctcctgtgtcttttcccttcatgctgccagcagggaagagaaccagtaggtgccagcccaggcaagcctgtggcccgcgtttctgtggctgtgggcaggagctgggccttgtgtctagttgggttttgctctgagaaggggagctgtgcctgaggccctctgtgtgccgtgtgtgctgtggggcgggtcgccacagcctgtgttaaagtgtttgctcttcctctgctgcctcctctcgaggcagggggtccttggctggctgaggcagtgtcaccttcctgagtgtcctctttggcctctgcagaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgca

SEQ ID NO: 115385 - DNA, 993 bp, Homo sapiens
  Payload ID: 2516
  Gene Symbol: CD164L2
  Gene Name: CD164 sialomucin-like 2
  Uniprot ID: Q6UWJ8
  ENST ID: ENST00000374030
  CDS Start-End: 142-666
ccacgcccccacctggccacgccccggttgcccaggtctcgctccgcacacgctcagccgagcccagtctgggagggacgcgcccggcagctgtccaccgatcccggccaccgcccccggccacccccaccccgcgagcccatggaggctccgggaccccgcgccttgcggactgcgctctgtggcggctgttgctgcctcctcctatgtgcccagctggctgtggctggtaaaggagctcgaggctttgggaggggagccctgatccgcctgaatatctggccggcggtccaaggggcctgcaaacagctggaggtctgtgagcactgcgtggagggagacggagcgcgcaatctctccagctgcgtgtgggagcagtgccggccagaggagccaggacactgtgtggcccaatctgaggtggtcaaggaaggttgctccatctacaaccgctcagaggcatgtccagctgctcaccaccaccccacctatgaaccgaagacagtcacaacagggagccccccagtccctgaggcccacagccctggatttgacggggccagctttatcggaggtgtcgtgctggtgttgagcctacaggcggtggctttctttgtgctgcacttcctcaaggccaaggacagcacctaccagacgctaatctgacccctttgggcctggactccatcctgaggggaaaggaggatgcagagggtggcctctgggcacccttgtgggtaagcggggggcgggggcgggaaaaactctggccgccagtttttggctcctgcgggcaccaagcaggctcagtgtctgatgcctgacatctcctcctgtcctgggcctggaacctgcagctgagaaaatccctcaaccacctcgtctcctccatcgcccctgctgggccccccagcctgacagtgggttgtatgcctgcctctttccaccaactggcctgggcactgcccccaaataaaggaactctgcactgca

SEQ ID NO: 115386 - DNA, 1512 bp, Homo sapiens
  Payload ID: 2517
  Gene Symbol: CD177
  Gene Name: CD177 molecule
  Uniprot ID: Q8N6Q3
  ENST ID: ENST00000378012
  CDS Start-End: 1-438
atgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagatcccatgatgggagctgcagaaggcccctttgggaaggctgagcaggttgactcttgaggccagcaaaagtggggtgcagagaaggtatctgatcaaatccagtgccctctcagtgccccctcactctgtctgtcactttcctagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccagtttgcaacctgctcaatgggacacaggaaattgggcccgtgggtatgactgagaactgcgatatgaaagattttctgacctgtcatcgggggaccaccattatgacacacggaaacttggctcaagaacccactgattggaccacatcgaataccgagatgtgcgaggtggggcaggtgtgtcaggagacgctgctgctcctagatgtaggactcacatcaaccctggtggggacaaaaggctgcagcactgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctc

SEQ ID NO: 115387 - DNA, 2222 bp, Homo sapiens
  Payload ID: 2517
  Gene Symbol: CD177
  Gene Name: CD177 molecule
  ENST ID: ENST00000618265
  CDS Start-End: 57-1370
aaaggacttgtttcctgctgaaaaagcagaaagagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcagacccaggatccttgaggtgcccagtctgcttgtctatggaaggctgtctggaggggacaacagaagagatctgccccaaggggaccacacactgttatgatggcctcctcaggctcaggggaggaggcatcttctccaatctgagagtccagggatgcatgccccagccagtttgcaacctgctcaatgggacacaggaaattgggcccgtgggtatgactgagaactgcgatatgaaagattttctgacctgtcatcgggggaccaccattatgacacacggaaacttggctcaagaacccactgattggaccacatcgaataccgagatgtgcgaggtggggcaggtgtgtcaggagacgctgctgctcctagatgtaggactcacatcaaccctggtggggacaaaaggctgcagcactgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatctaaagcctgcccttcattggtctggttcacgtctccaaaccagcttggatggtagcagagacttcagggtgctccagccaaacgtatttgggcatcaccatgacctgggaggggaagatgcactgagacgtatgaggcttccagcctagcagccagggccctagcacaaacaggaggctcgccccatctgagcaactgcaggagaggttagtacagtcatgcattgcttaacgacagggacgtgtcgttagaaatgtgtcgttaggtgattttatgaccataggaacattgtagcgtgcacttacaccaacccagatggtacagcccaatacacacccaggatggacgctagagtcgactgctcctaggctacaagcctgcagtgcatgttatggtgtgaatactgcaggcaatcttaacaccacggcaagtatttgtgcatctacacacatctaaacatagaaaaggtacagcataaatacactattgtcatctcagcaga

SEQ ID NO: 115388 - DNA, 536 bp, Homo sapiens
  Payload ID: 2517
  Gene Symbol: CD177
  Gene Name: CD177 molecule
  ENST ID: ENST00000607855
  CDS Start-End: 25-444
gagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcaggtgcctgcgggagggtcgggaggagagggaggggctgctagaaggggatccgctgagcacagaggggctgttacggagtccctcccaccctcgctcgctatcccgaccctcgctggctccatccctcccctga

SEQ ID NO: 115389 - DNA, 5388 bp, Homo sapiens
  Payload ID: 2518
  Gene Symbol: CD180
  Gene Name: CD180 molecule
  Uniprot ID: Q99467
  ENST ID: ENST00000256447
  CDS Start-End: 159-2144
acagagccacagaatgctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacgatcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagaccgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaagaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaacttggtatcaaatcgactccattaatcttcttaatccttaggtctgtaaggtctctgtaatgcccctagggtgtgaatggctataaaaaatagaacccacccccaaggtttagaatttcttccacatttgcctcactcagttcagaaaccaggcaggctctctctgcctatctggtgttctggctcttatgttacagatcctaacttgcaggtgggctgtgacccaaaatgctcttctcatttgggcatccggttcttagaagtctcttttccagaagaactgtgaaataaatcgtggtttggttctcaggcttgcccttaaaagcctatttgcttcggagagcatttgaattagcacatttacgtgaaaatgaggaagaaggcatccctgcatgctagctgttgggaacacagtaaagctggcttagtgagaagtggtttctgttgaggctggggatgtcaccaaaggtcacaccagccatggacaggggcctgaaccactgaatgcagatagacaaagagcaatgtcatgacttaggcttaaagggccatactcacacaggcctgtatcttctgaagtcttgattgccagacaagcttggcgggagctcctggactcaagtggtgcattgttctgttcaataaccaattttagggtagagatagagatggtaacttatagttatgaaattctgataagctaacaaaataaaaatggatccaaccaatcagaatatattagtccttaagttgaaggcatactagtgggacatcataacagagtgaaaacttgggggtcatcctttttgtctcttcgcccccaggaaaagcagggcaggcagggaacagcagtgggtgaacctcttctctgctcagggatttcaggccttcacacttgctctttcctttgcctctaagatgctgccattggcctccaaatggctccttccttcatcttgagatttcagtgctaatattttctcctttgagggatttcttctctgacctagctaatccaaagcaacctctatgcctcacctggttttattatctttataatgcttatcagtgtttggaattaacttcttcatttgttttaattagtttctcttgtcttgtctctcccaaatacaagtgccatgagagggtctttgcctaaagataccctagaacatgcctgggacatagtaaggactctctctctctctctccatatgtgtgtgtgtgtgtatgtgtgtgtatgtgtgtgtgtatatatatatataattttttttttgagactgattcttgctctgtcgcccaggctggagtgctatagtgcaatcttggctcactgtaacctccgcctcccaggttccagcgattctcctgcctcagcctcctgagtagctgggattacaggcgcccaccaccacgcctggctaatttttgtatttttagtagagacagggtttcaccatgttggccaggctggtcttgaactcctgacctcaagtgatctgcccgcctcggcctcccaaagtgctgggattacagatgagagccatcgtgcccggccaagattcaatatatttttaatatgtgctgatccctgagcctttattagctcctagttctgccaccatgcctatgctgctgactcttagctcctgacctctccacggtttcctgggcctcccacatgtttttcactggcatctcctagggaagtttttacaaaatggattcccaggcctcacccccagatactgagattctgttggactgaggttggctcagggttcccagccaaatgattccatgtaaaatgtggaaggtccaaactctaagaatccagtcttagacagcaccaacccattgagtccctgcatattctgtcacaggtaagctctttcttgccttagggatttaagctgcagatggaaaatactaattgctgatttaccaacccatagacatactgccctccataatatttaatatgtaacttggaaaaacgaaacaattctgtagaaaacctctgatgtgaattacatcacactaacaatgaaaggggcccaggccttagcaaagcataattgcccatcctgctttcacttctcaggcccgctcccttccatgcgatgcagcttgctgctccgtaactgatctaaggctttgtgacagctcctctgttttaagcaacagtaaattcaccccacaaagtcagaaagggagcttgttgatggctgctgtcaattttattgctttaacctgtttactaggatagactctgtaacatggtgtgtttattggttttatgtattgcatgttgttgctgctctgacaagctactcctataaaaatgtgttattattgcacgatgtagctcagtgagctgaccctgcatttcaaagggtactggagcaaatagcactgaagtccataaaagctgactggcctccatcacagaggactctctgcatgagctgcaactcctacaacccaggagagaattacacctttccctgtgccagcagccactgcttagtacagcacagcccttgaacacaggcaatatctgtaaaattccaagacagaaaactgtcgtgccattcttatttgtccaactctccaatcagtgtagtttgcaattttgatgtttataaaagtatgaaacaaa

SEQ ID NO: 115390 - DNA, 1932 bp, Homo sapiens
  Payload ID: 2519
  Gene Symbol: CD19
  Gene Name: CD19 molecule
  Uniprot ID: P15391
  ENST ID: ENST00000324662
  CDS Start-End: 45-1715
gcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaa

SEQ ID NO: 115391 - DNA, 1957 bp, Homo sapiens
  Payload ID: 2519
  Gene Symbol: CD19
  Gene Name: CD19 molecule
  Uniprot ID: P15391
  ENST ID: ENST00000538922
  CDS Start-End: 63-1736
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcct

SEQ ID NO: 115392 - DNA, 1707 bp, Homo sapiens
  Payload ID: 2519
  Gene Symbol: CD19
  Gene Name: CD19 molecule
  Uniprot ID: P15391
  ENST ID: ENST00000567541
  CDS Start-End: 34-1707
gcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtga

SEQ ID NO: 115393 - DNA, 1901 bp, Homo sapiens
  Payload ID: 2519
  Gene Symbol: CD19
  Gene Name: CD19 molecule
  ENST ID: ENST00000611258
  CDS Start-End: 17-1420
ggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttcc

SEQ ID NO: 115394 - DNA, 2096 bp, Homo sapiens
  Payload ID: 2520
  Gene Symbol: CD1A
  Gene Name: CD1a molecule
  Uniprot ID: P06126
  ENST ID: ENST00000289429
  CDS Start-End: 534-1517
gggcagtcgtaggagactctgaaaaagcaaataaatcaatgttaaatcagaaatgtgaatgtagtaaggggctgaagagacaggggaagagaatacatgggaaaatattgaaaaggacagagtgatcaaaaagagcagggacatgggagcattgggcagcacactgggagccatttcactttatgctcttattgtatgattgagaaaaaaatgtccttagtggttaagtggcttttcaatgccacatcagacttgttccatagcagttgaattaggggaaggtgaataagttggaggttggtgacaaggagagaagctggaacagagaggagagtcagaaccagagggaaatgagagactgagtaggcatctcagggtttttgaaggagtggattttctttgttgcagtcaggggaggtttgtctgttggctgcagaaagaagtcagaatagagatatcgtggggtaggtttgtttggaacagaaatcaaagaccaatttttctgagagaaggaaataacatctgcaaatgatatgctgtttttgctacttccattgttagctgttctcccaggtgatggcaatgcagacgggctcaaggagcctctctccttccatgtcacctggatcgcatccttttacaaccattcctggaaacaaaatctggtctcaggttggctgagtgatttgcagactcatacctgggacagcaattccagcaccatcgttttcctgtgcccctggtccaggggaaacttcagcaatgaggagtggaaggaactggaaacattattccgtatacgcaccattcggtcatttgagggaattcgtagatacgcccatgaattgcagtttgaatatccttttgagatacaggtgacaggaggctgtgagctgcactctggaaaggtctcaggaagcttcttgcagttagcttatcaaggatcagactttgtgagcttccagaacaattcatggttgccatatccagtggctgggaatatggccaagcatttctgcaaagtgctcaatcagaatcagcatgaaaatgacataacacacaatcttctcagtgacacctgcccacgtttcatcttgggtcttcttgatgcaggaaaggcacatctccagcggcaagtgaagcccgaggcctggctgtcccatggccccagtcctggccctggccatctgcagcttgtgtgccatgtctcaggattctacccaaagcccgtgtgggtgatgtggatgcggggtgagcaggagcagcagggcactcagcgaggggacatcttgcccagtgctgatgggacatggtatctccgcgcaaccctggaggtggccgctggggaggcagctgacctgtcctgtcgggtgaagcacagcagtctagagggccaggacatcgtcctctactgggagcatcacagttccgtgggcttcatcatcttggcggtgatagtgcctttacttcttctgataggtcttgcgctttggttcaggaaacgctgtttctgttaagacacaccatgagcctcctcgtcacccttctccttttggggtgagagaccagcagcccaagggctccagacacacctgaacacatcgtgatgatgacgtcctctcaactctctttgtaaaaattttgttatttttgcttgtttctgattaatgattgtttgtcaatataagctcaatttaattttgcaggatttgttgttctgacctgggttctgggacttttaaattcaaattttatctccagatggaatggggtcctagcaacctccacatgttcaactattaatggatcatcaggcctgttttagatatcccttactccagagggccttccctgacttacaagtgggaagcagtctcttcctggtctgaactcccgccacattttagccgtactttgctaactgtgctcctcacttcctcttcttcattgcagttatttagatcccccctttccttctaatttttcagctccttcaatgcaaagtacatgtatttttaatatatgcatccctggtgaaggatcttgcctgcatgaaacatgttctcaataaaactctgtgttgaatttatgccaaa

SEQ ID NO: 115395 - DNA, 1395 bp, Homo sapiens
  Payload ID: 2521
  Gene Symbol: CD1B
  Gene Name: CD1b molecule
  Uniprot ID: P29016
  ENST ID: ENST00000368168
  CDS Start-End: 109-1110
ggcagttggaagagagaagaagtcactacagggtactgaggaaaagctttgctgaaattggagatcaaataccagctctgccagtaagaagttgcatctcccagtgaaatgctgctgctgccatttcaactgttagctgttctctttcctggtggtaacagtgaacatgccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgactta

SEQ ID NO: 115396 - DNA, 1024 bp, Homo sapiens
  Payload ID: 2521
  Gene Symbol: CD1B
  Gene Name: CD1b molecule
  ENST ID: ENST00000451207
  CDS Start-End: 1-739
ctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgactta

SEQ ID NO: 115397 - DNA, 1435 bp, Homo sapiens
  Payload ID: 2522
  Gene Symbol: CD1C
  Gene Name: CD1c molecule
  Uniprot ID: P29017
  ENST ID: ENST00000368170
  CDS Start-End: 280-1281
aggcagttgaggaagggaagtagatataatggagcttagtggcagagcagctggaatcctgagagaagagaataactttagttcagagcaggtggggaaatgagagattgagtaggaggaccaaggttgagggaagcagatcttcttagttgctgtcagcggctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggacaccacttttccatgaattggattgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaa

SEQ ID NO: 115398 - DNA, 855 bp, Homo sapiens
  Payload ID: 2522
  Gene Symbol: CD1C
  Gene Name: CD1c molecule
  ENST ID: ENST00000443761
  CDS Start-End: 1-844
tttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactgggctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaa

SEQ ID NO: 115399 - DNA, 2253 bp, Homo sapiens
  Payload ID: 2523
  Gene Symbol: CD1D
  Gene Name: CD1d molecule
  Uniprot ID: P15813
  ENST ID: ENST00000368171
  CDS Start-End: 500-1507
gttttctacccaagaatgctacttcaggagatcagtcaaaaggttagggtgatggtgacggtggaaatatagaaaaaggaatttattcaagaggtattcaaaaagaagtgaaatagagatgagttggagatagattggataaaaagagtgagggagagggaggtgtcaggctgcagcccaggttctgagttgccaaagaggagtcttttcctccaggaaattgagacacgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaagtcccgcaaaggcttttccccctccgctgcctccagatctcgtccttcgccaatagcagctggacgcgcaccgacggcttggcgtggctgggggagctgcagacgcacagctggagcaacgactcggacaccgtccgctctctgaagccttggtcccagggcacgttcagcgaccagcagtgggagacgctgcagcatatatttcgggtttatcgaagcagcttcaccagggacgtgaaggaattcgccaaaatgctacgcttatcctatcccttggagctccaggtgtccgctggctgtgaggtgcaccctgggaacgcctcaaataacttcttccatgtagcatttcaaggaaaagatatcctgagtttccaaggaacttcttgggagccaacccaagaggccccactttgggtaaacttggccattcaagtgctcaaccaggacaagtggacgagggaaacagtgcagtggctccttaatggcacctgcccccaatttgtcagtggcctccttgagtcagggaagtcggaactgaagaagcaagtgaagcccaaggcctggctgtcccgtggccccagtcctggccctggccgtctgctgctggtgtgccatgtctcaggattctacccaaagcctgtatgggtgaagtggatgcggggtgagcaggagcagcagggcactcagccaggggacatcctgcccaatgctgacgagacatggtatctccgagcaaccctggatgtggtggctggggaggcagctggcctgtcctgtcgggtgaagcacagcagtctagagggccaggacatcgtcctctactggggtgggagctacacctccatgggcttgattgccttggcagtcctggcgtgcttgctgttcctcctcattgtgggctttacctcccggtttaagaggcaaacttcctatcagggcgtcctgtgactcgccttgccacatctgtgtctctggaacccaggacctctggacctcaggttcctaagacttcagtcctggtctgctcaggaattgaagatgtaaggaattgaagataggagagataccttgaaaaagtagagaacagtcatgaggcagctttcatcacacccttttaacatttatctaaaagaatttaaattctttttcaaaaattacactacaagtttataagcccaaatggctctgtgaaatcagaagtgcaaaggtgtgcaaacttgtatctgaagacctaccagggacaagcaggtaagagctgatgtgagtgtgtgtgatgggatctgtaaggaactggaacacacatgtcctatccaaaggaatcagctgcagctgcttgttgtcaagtataaagtcaggacctggcttggctttaaccgtttttcaagaaaactggaaatctggattttcagcgaacatgcctgattttaaaaggttgactcaagtttttacaaaatactatgtgggacacctcaaatacatacctactgactgatgacaaacccaggagtttgtgtgtcttttataaaaagtttgccctggatgtcatattggcagttggaggacacagtttctattgtaaatttggatttacgactgaagaaggacattttctctttaaaagaaagttaggttataagaaacagaggcgtctcacatttttacttggtgtaattaataaacgaagataaatcata

SEQ ID NO: 115400 - DNA, 435 bp, Homo sapiens
  Payload ID: 2524
  Gene Symbol: CD1E
  Gene Name: CD1e molecule
  Uniprot ID: P15812
  ENST ID: ENST00000368154
  CDS Start-End: 1-435
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 115401 - DNA, 696 bp, Homo sapiens
  Payload ID: 2524
  Gene Symbol: CD1E
  Gene Name: CD1e molecule
  Uniprot ID: P15812
  ENST ID: ENST00000368155
  CDS Start-End: 1-696
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 115402 - DNA, 861 bp, Homo sapiens
  Payload ID: 2524
  Gene Symbol: CD1E
  Gene Name: CD1e molecule
  Uniprot ID: P15812
  ENST ID: ENST00000368156
  CDS Start-End: 1-861
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 115403 - DNA, 399 bp, Homo sapiens
  Payload ID: 2524
  Gene Symbol: CD1E
  Gene Name: CD1e molecule
  Uniprot ID: P15812
  ENST ID: ENST00000368157
  CDS Start-End: 1-399
atgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 115404 - DNA, 1727 bp, Homo sapiens
  Payload ID: 2524
  Gene Symbol: CD1E
  Gene Name: CD1e molecule
  Uniprot ID: P15812
  ENST ID: ENST00000368160
  CDS Start-End: 1-1131
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgat

SEQ ID NO: 115405 - DNA, 1689 bp, Homo sapiens
  Payload ID: 2524
  Gene Symbol: CD1E
  Gene Name: CD1e molecule
  Uniprot ID: P15812
  ENST ID: ENST00000368161
  CDS Start-End: 1-873
atgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaat

SEQ ID NO: 115406 - DNA, 936 bp, Homo sapiens
  Payload ID: 2524
  Gene Symbol: CD1E
  Gene Name: CD1e molecule
  ENST ID: ENST00000368162
  CDS Start-End: 1-181
tgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagt

SEQ ID NO: 115407 - DNA, 1678 bp, Homo sapiens
  Payload ID: 2524
  Gene Symbol: CD1E
  Gene Name: CD1e molecule
  Uniprot ID: P15812
  ENST ID: ENST00000368163
  CDS Start-End: 80-1045
gggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgact

SEQ ID NO: 115408 - DNA, 869 bp, Homo sapiens
  Payload ID: 2524
  Gene Symbol: CD1E
  Gene Name: CD1e molecule
  Uniprot ID: P15812
  ENST ID: ENST00000368164
  CDS Start-End: 74-379
ggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatc

SEQ ID NO: 115409 - DNA, 1003 bp, Homo sapiens
  Payload ID: 2524
  Gene Symbol: CD1E
  Gene Name: CD1e molecule
  Uniprot ID: P15812
  ENST ID: ENST00000368165
  CDS Start-End: 107-1003
caagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaattgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 115410 - DNA, 1271 bp, Homo sapiens
  Payload ID: 2524
  Gene Symbol: CD1E
  Gene Name: CD1e molecule
  Uniprot ID: P15812
  ENST ID: ENST00000368166
  CDS Start-End: 105-668
agggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgt

SEQ ID NO: 115411 - DNA, 1458 bp, Homo sapiens
  Payload ID: 2524
  Gene Symbol: CD1E
  Gene Name: CD1e molecule
  Uniprot ID: P15812
  ENST ID: ENST00000368167
  CDS Start-End: 240-1406
gaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccagatagtgcaagcttctgctggtcaatttcagcttgaataccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccg

SEQ ID NO: 115412 - DNA, 1820 bp, Homo sapiens
  Payload ID: 2524
  Gene Symbol: CD1E
  Gene Name: CD1e molecule
  Uniprot ID: P15812
  ENST ID: ENST00000444681
  CDS Start-End: 294-1163
ttccagcagttagtgcaattagggaggttgggaggatgtacacaagagcagggagaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagaccccttcgagatccagatattagctggctgtagaatgaatgccccacaaatcttcttaaatatggcatatcaagggtcagatttcctgagtttccaaggaatttcctgggagccatctccaggagcagggatccgggcccagaacatctgtaaagtgctcaatcgctacctagatattaaggaaatactgcaaagccttcttggtcacacctgccctcgatttctagcggggctcatggaagcaggggagtcagaactgaaacggaaagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtgacatttgctttaccttatacataaaatccttgtctgcatcttcttaaacaccgtccatgtcccataagggaagcatgcttttatttaaacagtttatactagcaaagatactgacccctttaggaatactttttccccatcttccagagattttttttttcctgctttggctacatatccatcattgtttatttttgaaactataatccagatacttctttttcatggattcccgagatcacccaattgatagctcttctgtactccccaaattgaactgatcttcacaagcacattcatctcttcctactctgaacagtagttatttaggtttttgctctttttttttttttaatctcagttgcttgaaagtaggatttaggtatttgtgtctgtattcatgaccaaaaatcttatctgaattcagggccagcttcataagcatgtgacctgtgcagacacatggaatcgtatgctctgcaagaacccatgctagatttaatgctctgctgttgtcatcttggaatccttagtcattttcaaacaagagatattgtattttcatttttcactgaccccacaaattatatagctgattcagtgtgaatgtaatatttctcaataaatgctgactgaaataaatttgttgttagatcaa

SEQ ID NO: 115413 - DNA, 745 bp, Homo sapiens
  Payload ID: 2524
  Gene Symbol: CD1E
  Gene Name: CD1e molecule
  Uniprot ID: P15812
  ENST ID: ENST00000452291
  CDS Start-End: 146-745
gggaagtcagcagagggagaggtttgtctgtctgtacagcaagggaagtcagacgagagtgcaagagggtgtggagaggggtactgatatctgaattattagggcaggtgtcctgccaaggaatccctcctttaacagagcttcaatgctgctcctgttcctcctcttcgagggtctctgctgtcctggggaaaatacagcagtgaagccagaggcctggctgtcctgtggccccagtcctggccctggccgtctgcagcttgtgtgccatgtctcaggattctacccaaagcccgtgtgggtgatgtggatgcggggtgagcaggagcagcggggcactcagcgaggggacgtcctgcctaatgctgacgagacatggtatctccgagcaaccctggatgtggcggctggggaggcagctggcctgtcctgtcgggtgaaacacagcagtctagggggccatgatctaatcatccattggggtggatattccatctttctcatcctgatctgtttgactgtgatagttaccctggtcatattggttgtagttgactcacggttaaaaaaacagagttcaaataagaacattctttctccccacacacccagccctgtctttctcatgggagccaacactcaggacaccaagaattcaagacatcagttctgcttggcacaagtatcgtggatcaaaaacagagtattgaagaagtggaagacacgcctaaaccaactctggtga

SEQ ID NO: 115414 - DNA, 3421 bp, Homo sapiens
  Payload ID: 2525
  Gene Symbol: CD2BP2
  Gene Name: CD2 (cytoplasmic tail) binding protein 2
  Uniprot ID: O95400
  ENST ID: ENST00000305596
  CDS Start-End: 177-1202
agttagttccctaacccgagtgaagccacttccgggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatccttcttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctctca

SEQ ID NO: 115415 - DNA, 1417 bp, Homo sapiens
  Payload ID: 2525
  Gene Symbol: CD2BP2
  Gene Name: CD2 (cytoplasmic tail) binding protein 2
  Uniprot ID: O95400
  ENST ID: ENST00000569466
  CDS Start-End: 254-1279
gggggatccagagggtccgctcctccgtccccgccccgtttaactcgcggatgctagacccaagtcctggaggcctcctggctgccagcttcctttcggcccctgcttttgtgctccctccgctcccaaactgtacctgtcacagaccaggaaaaatgtttgctgtgctgcgtctgttggcgagtcccctcctcacccggttcccttcctctgcatcctttcctcagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgta

SEQ ID NO: 115416 - DNA, 478 bp, Homo sapiens
  Payload ID: 2526
  Gene Symbol: CD2
  Gene Name: CD2 molecule
  ENST ID: ENST00000369477
  CDS Start-End: 27-428
atcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaaggtaagtgttcattcccttaattgctttatttcagtgtgggtgctatttggcaagttggaaaatagcattt

SEQ ID NO: 115417 - DNA, 1609 bp, Homo sapiens
  Payload ID: 2526
  Gene Symbol: CD2
  Gene Name: CD2 molecule
  Uniprot ID: P06729
  ENST ID: ENST00000369478
  CDS Start-End: 109-1164
gtaaagagaggcacgtggttaagctctcggggtgtggactccaccagtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactag

SEQ ID NO: 115418 - DNA, 2129 bp, Homo sapiens
  Payload ID: 2527
  Gene Symbol: CD200
  Gene Name: CD200 molecule
  Uniprot ID: P41217
  ENST ID: ENST00000315711
  CDS Start-End: 58-867
agagctccaggcgcacatccgcagtcagccacctcgcgcgcgcctccaggagcaaggatggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactccaaa

SEQ ID NO: 115419 - DNA, 1997 bp, Homo sapiens
  Payload ID: 2527
  Gene Symbol: CD200
  Gene Name: CD200 molecule
  ENST ID: ENST00000383681
  CDS Start-End: 176-763
agtcagccacctcgcgcgcgcctccaggagcaaggatggagaggctgtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaata

SEQ ID NO: 115420 - DNA, 942 bp, Homo sapiens
  Payload ID: 2527
  Gene Symbol: CD200
  Gene Name: CD200 molecule
  ENST ID: ENST00000498096
  CDS Start-End: 146-598
aaaacggagtgggagaagggggctagcgaggaggaagaggcgggaggtgcggcaggggcacaggtgacgctcctcccgcctgcctagcagagctccaggcgcacatccgcagtcagccacctcgcgcgcgcctccaggagcaaggatggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgag

SEQ ID NO: 115421 - DNA, 2017 bp, Homo sapiens
  Payload ID: 2527
  Gene Symbol: CD200
  Gene Name: CD200 molecule
  ENST ID: ENST00000478595
  CDS Start-End: 176-406
agtcagccacctcgcgcgcgcctccaggagcaaggatggagaggctgtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactcc

SEQ ID NO: 115422 - DNA, 1524 bp, Homo sapiens
  Payload ID: 2527
  Gene Symbol: CD200
  Gene Name: CD200 molecule
  Uniprot ID: P41217
  ENST ID: ENST00000473539
  CDS Start-End: 58-942
agagctccaggcgcacatccgcagtcagccacctcgcgcgcgcctccaggagcaaggatggagaggctgactctgaccaggacaattgggggccctctccttacagctacactcctaggaaagaccaccatcaatgattaccaggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagtt

SEQ ID NO: 115423 - DNA, 802 bp, Homo sapiens
  Payload ID: 2527
  Gene Symbol: CD200
  Gene Name: CD200 molecule
  ENST ID: ENST00000606471
  CDS Start-End: 196-802
ggagaatggcgggaacccgggaggcggagcttgtagtgagccaagatagcgccactgcactccagcctggaccacagagcgagactccgtctcaagaagaagaagaaggagaagaaggagaaggagaagggaaaaaagaatcctcatcattaatgcaagtggaaggaaactcttcaccaaagaattgatcacatcatgaaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaag

SEQ ID NO: 115424 - DNA, 551 bp, Homo sapiens
  Payload ID: 2527
  Gene Symbol: CD200
  Gene Name: CD200 molecule
  ENST ID: ENST00000607597
  CDS Start-End: 365-551
attttgggaggccgaggcgggcggatcacgaggtcaagagaccgagaccatcctggctaacatggtgaaaccccgtctctactaaaaatacaaaaaattagccgggcatggtggcgggcgtctgtagtcccagctactcgggaggctgaggcaggagaatggcgggaacccgggaggcggagcttgtagtgagccaagatagcgccactgcactccagcctggaccacagagcgagactccgtctcaagaagaagaagaaggagaagaaggagaaggagaagggaaaaaagaatcctcatcattaatgcaagtggaaggaaactcttcaccaaagaattgatcacatcatgaaaggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctg

SEQ ID NO: 115425 - DNA, 1692 bp, Homo sapiens
  Payload ID: 2528
  Gene Symbol: CD200R1
  Gene Name: CD200 receptor 1
  ENST ID: ENST00000295863
  CDS Start-End: 247-885
atacaggaaatctattgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtacctgtgtggaggaaaagtactgagtgaagggcagaaaaagagaaaacagaaatgctctgcccttggagaactgctaacctagggctactgttgattttgactatcttcttagtggccgttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactgttaagagtacatgccactgggaggtccacaatgtgtctaccgtgacctgccacgtctcccatttgactggcaacaagagtctgtacatagagctacttcctggatgaaatgcagccctatgccagctacacagagaagaacaatcctctctatgatactacaaacaaggtgaaggcatctgaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatatacatgcacatatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaa

SEQ ID NO: 115426 - DNA, 2299 bp, Homo sapiens
  Payload ID: 2528
  Gene Symbol: CD200R1
  Gene Name: CD200 receptor 1
  Uniprot ID: Q8TD46
  ENST ID: ENST00000308611
  CDS Start-End: 266-1312
gtctttgcttcagggcttcatacaggaaatctattgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtacctgtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactgttaagagtacatgccactgggaggtccacaatgtgtctaccgtgacctgccacgtctcccatttgactggcaacaagagtctgtacatagagctacttcctgttccaggtgccaaaaaatcagcaaaattatatattccatatatcatccttactattattattttgaccatcgtgggattcatttggttgttgaaagtcaatggctgcagaaaatataaattgaataaaacagaatctactccagttgttgaggaggatgaaatgcagccctatgccagctacacagagaagaacaatcctctctatgatactacaaacaaggtgaaggcatctgaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatatacatgcacatatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaatgtttcttgtgcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttata

SEQ ID NO: 115427 - DNA, 847 bp, Homo sapiens
  Payload ID: 2528
  Gene Symbol: CD200R1
  Gene Name: CD200 receptor 1
  Uniprot ID: Q8TD46
  ENST ID: ENST00000440122
  CDS Start-End: 56-622
tgtacctgtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttaggtaaggagcatcatatattgaggtatttcacatcaccagatttgtgacggaaacaaatgtctctctgaattccatatgctttatgtgaaaaccgaagcatttttttccctctttcctctctgcagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactg

SEQ ID NO: 115428 - DNA, 778 bp, Homo sapiens
  Payload ID: 2528
  Gene Symbol: CD200R1
  Gene Name: CD200 receptor 1
  Uniprot ID: Q8TD46
  ENST ID: ENST00000490004
  CDS Start-End: 56-553
tgtacctgtgtggaggaaaagtactgagtgaagggcagaaaaagagaaaacagaaatgctctgcccttggagaactgctaacctagggctactgttgattttgactatcttcttagtggccgcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttaggtaaggagcatcatatattgaggtatttcacatcaccagatttgtgacggaaacaaatgtctctctgaattccatatgctttatgtgaaaaccgaagcatttttttccctctttcctctctgcagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactg

SEQ ID NO: 115429 - DNA, 3679 bp, Homo sapiens
  Payload ID: 2528
  Gene Symbol: CD200R1
  Gene Name: CD200 receptor 1
  Uniprot ID: Q8TD46
  ENST ID: ENST00000471858
  CDS Start-End: 234-1211
attgctgtgtcaagttccagagaaaagcttctgttcgtccaagttactaaccaggctaaaccacatagacgtgaaggaaggggctagaaggaagggagtgccccactgttgatggggtaagaggatcctgtactgagaagttgaccagagagggtctcaccatgcgcacagttccttctgtacctgtgtggaggaaaagtactgagtgaagggcagaaaaagagaaaacagaaatgctctgcccttggagaactgctaacctagggctactgttgattttgactatcttcttagtggccgcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgatgagagaataacctgggtctccagacctgatcagaattcggaccttcagattcgtaccgtggccatcactcatgacgggtattacagatgcataatggtaacacctgatgggaatttccatcgtggatatcacctccaagtgttagttacacctgaagtgaccctgtttcaaaacaggaatagaactgcagtatgcaaggcagttgcagggaagccagctgcgcatatctcctggatcccagagggcgattgtgccactaagcaagaatactggagcaatggcacagtgactgttaagagtacatgccactgggaggtccacaatgtgtctaccgtgacctgccacgtctcccatttgactggcaacaagagtctgtacatagagctacttcctgttccaggtgccaaaaaatcagcaaaattatatattccatatatcatccttactattattattttgaccatcgtgggattcatttggttgttgaaagtcaatggctgcagaaaatataaattgaataaaacagaatctactccagttgttgaggaggatgaaatgcagccctatgccagctacacagagaagaacaatcctctctatgatactacaaacaaggtgaaggcatctgaggcattacaaagtgaagttgacacagacctccatactttataagttgttggactctagtaccaagaaacaacaacaaacgagatacattataattactgtctgattttcttacagttctagaatgaagacttatattgaaattaggttttccaaggttcttagaagacattttaatggattctcattcatacccttgtataattggaatttttgattcttagctgctaccagctagttctctgaagaactgatgttattacaaagaaaatacatgcccatgaccaaatattcaaattgtgcaggacagtaaataatgaaaaccaaatttcctcaagaaataactgaagaaggagcaagtgtgaacagtttcttgtgtatcctttcagaatattttaatgtacatatgacatgtgtatatgcctatggtatatgtgtcaatttatgtgtccccttacatatacatgcacatatctttgtcaaggcaccagtgggaacaatacactgcattactgttctatacatatgaaaacctaataatataagtcttagagatcattttatatcatgacaagtagagctacctcattctttttaatggttatataaaattccattgtatagttatatcattatttaattaaaaacaaccctaatgatggatatttagattcttttaagttttgtttatttcttttaagttttgtttgtggtataaacaataccacatagaatgtttcttgtgcatatatctctttgtttttgagtatatctgtaggataactttcttgagtggaattgtcaggtcaaagggtttgtgcattttactattgatatatatgttaaattgtgtcaaatatatatgtcaaattccctccaacattgtttaaatgtgcctttccctaaatttctattttaataactgtactattcctgcttctacagttgccactttctctttttaatcaaccagattaaatatgatgtgagattataataagaattatactatttaataaaaatggatttatatttttggtcatgtttgtaagagagtgaatgcacgtgtgagaacattagcttcttctgaactcattatatctccacagaggtgttgatacttgatgcctaacagttttgcagatgtgctacattggaattgtgtatttttatggtgtacattctattgtgatatatttattgaataattaatgtctattgaccatataagtggcgaaaaatgcaccatagaggacatggggtatttatttacaaactatgagctacataataagcaagtggccatgggatggcatgaccctcccctccatatttttgtggagcaaaatattggcaatgtttatgtaaatcattgttaatatcatgaaattatttttaattaaaaacataagtctatttgctccatagcagaaaaaacatgagaagttttttcatcatgatagaaattgaaacaaaatatattcattcttcaatcataccatctgagatttttaagacagctattttgtcttataagtatatttttctccctctagacatttcagttactatggattttgtcctcaaagggacttttagtctattttggatgtaaagctaatctaatgacacttggcacatgatattttgatcaagccattttgacttgaccaaaaagcagtgtccattaggtttctgcatataaatattaccaagcaatgttcacaatagacatcattacactgtccttgaaatttattaattcttcatccaaccctggttgagctgaggctcatagttaggttcaagactatctgtttaaatattactgaaaaacaaagtaagacagtactatgcttacctcttaacttgataatgtcaaaacaggcatgttaaatgacatcatagaaaagacttcaagataatttatagaagttaaattatattgtacagaaaataattgtatgaaaatctctactatggggctggaacatggttgaacattagaatgatataaaaaattatatatattctccaaatccacgctagacctgtcaaattagagaatctagagattagacctggcgtgtcagcaaggtcatccaggaagcagaggctgagacggagttaggtgtgattacttacatagtcgattacattttacaaataacattttatatgtctcatttactgtgctttctccccatcccattttgtatcttttcctttgctttgctagatttgtcaattttctctctctttctctgtctctctctctttcaatatctctaataatttgaaagtaattcatcataactaaatatctattggggttatgcttcacttacaaacttctgaaaacggctttactgagatataattgatatatttaagtgtacagtttgttaaattttgcacatatttaaaatgtggactttggtaaatgttgacatagttttacatctgtgaaaccatcagcataatcaagataataaacttgtccatcacccccc

SEQ ID NO: 115430 - DNA, 1296 bp, Homo sapiens
  Payload ID: 2529
  Gene Symbol: CD200R1L
  Gene Name: CD200 receptor 1-like
  Uniprot ID: Q6Q8B3
  ENST ID: ENST00000398214
  CDS Start-End: 227-1042
caaaactcactgacatttcccatcagtggttaatcagtcaaaaacatatagaatgacagcaaaaattaaagataagcaagataatgaagaaatatgttttgcaatcctgttgaagacagaataagcaaaagtgaccaagagaaacagattcaccaagtctgttgattgatttaaagtggatttatgtttaagtagaaaaccactccaaaagcatactttagggaagatgtcagctccaagattactgatttccatcattatcatggtgtctgcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatgaagtttccctataaaccctcaaccacctattcattgacttcttttgtgttagagtgaataaaattttgttcatgccagt

SEQ ID NO: 115431 - DNA, 750 bp, Homo sapiens
  Payload ID: 2529
  Gene Symbol: CD200R1L
  Gene Name: CD200 receptor 1-like
  ENST ID: ENST00000448932
  CDS Start-End: 1-750
atgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagtaaattttta

SEQ ID NO: 115432 - DNA, 1597 bp, Homo sapiens
  Payload ID: 2529
  Gene Symbol: CD200R1L
  Gene Name: CD200 receptor 1-like
  Uniprot ID: Q6Q8B3
  ENST ID: ENST00000488794
  CDS Start-End: 591-1343
aacatcactcagatctctgccttttatcttcacatggtgttcctgtgtatgcgcccagttttcctctttttataaggacaccataaaaagctaagaagtgcaaaagaagaaaaaaagaataaaccaaagacgccagtcatattggattagggaccaatctatttcagcatggccacatcttaactaattatatctccaatgaccctatttccaaataaggtcatcttctgagcaaaactcactgacatttcccatcagtggttaatcagtcaaaaacatatagaatgacagcaaaaattaaagataagcaagataatgaagaaatatgttttgcaatcctgttgaagacagaataagcaaaagtgaccaagagaaacagattcaccaagtctgttgattgatttaaagtggatttatgtttaagtagaaaaccactccaaaagcatactttagggaagatgtcagctccaagattactgatttccatcattatcatggtgtctgcctcagataataattcctgtctgatgacacaactggaaatacaaagttagagaatacgtcttaatgaagcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatgaagtttccctataaaccctcaaccacctattcattgacttcttttgtgttagagtgaataaaattttgttcatgccagt

SEQ ID NO: 115433 - DNA, 1377 bp, Homo sapiens
  Payload ID: 2529
  Gene Symbol: CD200R1L
  Gene Name: CD200 receptor 1-like
  ENST ID: ENST00000486723
  CDS Start-End: 220-387
cactgacatttcccatcagtggttaatcagtcaaaaacatatagaatgacagcaaaaattaaagataagcaagataatgaagaaatatgttttgcaatcctgttgaagacagaataagcaaaagtgaccaagagaaacagattcaccaagtctgttgattgatttaaagtggatttatgtttaagtagaaaaccactccaaaagcatactttagggaagatgtcagctccaagattactgatttccatcattatcatggtgtctggctgtacaggaagcatggctgaggaggcctcaaaaaacttacaatcatggtggaaatgtgaaggggaagcaagcatgtcttcaaatggccagcagaagcctcagataataattcctgtctgatgacacaactggaaatacaaagttagagaatacgtcttaatgaagcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcagaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatg

SEQ ID NO: 115434 - DNA, 762 bp, Homo sapiens
  Payload ID: 2529
  Gene Symbol: CD200R1L
  Gene Name: CD200 receptor 1-like
  ENST ID: ENST00000617549
  CDS Start-End: 1-762
gcttcaagtagttcatgcatgggtggaaagcagatgacacagaactattcaacaatttttgcagaaggtaacatttcacagcctgtactgatggatataaatgctgtgctttgttgccctcctatcgcattaagaaatttgatcataataacatgggaaataatcctgagaggccagccttcctgcacaaaagcctacaagaaagaaacaaatgagaccaaggaaaccaactgtactgttgagagaataacctgggtctctagacctgatcagaattcggaccttcagattcgtccggtggacaccactcatgacgggtattacagaggcatagtggtaacacctgatgggaatttccatcgtggatatcacctccaagtgttagttacacccgaagtgaacctatttcaaagcaggaatataactgcagtatgcaaggcagttacagggaagccagctgcccagatctcctggatcccagagggatctattcttgccactaagcaagaatactggggcaatggcacagtgacggttaagagtacatgcccctgggagggccacaagtctactgtgacctgccatgtctcccatttgactggcaacaagagtctgtccgtaaagttgaattcaggtctcagaacctcaggatctccagcgttgtccttactgatcattctttatgtgaaactctctctttttgtggtcattctggtcaccacaggatttgttttcttccagaggataaatcatgtcaggtag

SEQ ID NO: 115435 - DNA, 1869 bp, Homo sapiens
  Payload ID: 2530
  Gene Symbol: CD207
  Gene Name: CD207 molecule, langerin
  Uniprot ID: Q9UJ71
  ENST ID: ENST00000410009
  CDS Start-End: 47-1033
gcagccagaagcacctgtgctcccaggataagggtgagcactcaggatgactgtggagaaggaggcccctgatgcgcacttcactgtggacaaacagaacatctccctctggccccgagagcctcctcccaagtccggtccatctctggtcccggggaaaacacccacagtccgtgctgcattaatctgcctgacgctggtcctggtcgcctccgtcctgctgcaggccgtcctttatccccggtttatgggcaccatatcagatgtaaagaccaatgtccagttgctgaaaggtcgtgtggacaacatcagcaccctggattctgaaattaaaaagaatagtgacggcatggaggcagctggcgttcagatccagatggtgaatgagagcctgggttatgtgcgttctcagttcctgaagttaaaaaccagtgtggagaaggccaacgcacagatccagatcttaacaagaagttgggaagaagtcagtaccttaaatgcccaaatcccagagttaaaaagtgatttggagaaagccagtgctttaaatacaaagatccgggcactccagggcagcttggagaatatgagcaagttgctcaaacgacaaaatgatattctacaggtggtttctcaaggctggaagtacttcaaggggaacttctattacttttctctcattccaaagacctggtatagtgccgagcagttctgtgtgtccaggaattcacacctgacctcggtgacctcagagagtgagcaggagtttctgtataaaacagcggggggactcatctactggattggcctgactaaagcagggatggaaggggactggtcctgggtggatgacacgccattcaacaaggtccaaagtgtgaggttctggattccaggtgagcccaacaatgctgggaacaatgaacactgtggcaatataaaggctccctcacttcaggcctggaatgatgccccatgtgacaaaacgtttcttttcatttgtaagcgaccctatgtcccatcagaaccgtgacaggacaggctcccaagctcactctttgagctccaacgcttgttaaacatgaggaaatgcctctttcttccccagactccaggatgactttgcacgttaatttttcttgcttcaaaattgtcccacagtggcattctggagtccgtctgtcttggctggaaattctctgacgtcttggaggcagctggaatggaaaggagaattcaggttaaagtgggaggggtgggtagagaggatttagaagttccaattgccctgctaaggaggatcaagacccgtaatccggcataacaccctggggttttccactctttcagagaaacctcagcttcatcacatcaaagttactccagagcaaccaagcaattctcctgatattgtcatccagggcttttcttggccaaaccccctagaatttccatgtctctgcttagctgtgctggcagctagcagctggctgtgtttgcagtgcaaatagctctgttcttggaaatcctgctcatggtatgtccccagtggtttcttcatccacatcatctaaagcctgaacccgttcttctctggttcaagtcagtggctgacacggacttgtatctccttcagagctcggctggcacccagcctcccttctccttccactcccttagtacactggagtgccgagccctgccttccacccagcgtccatccagcccctgtcctcacctctccggcacctcctcctccttctgcatttcctatcttcctgtgtcttgtgcatgggaagcagccttcagtgccttcatgaattcaccttccagcttcctcagaataaaatgctgcctgggtcaaggact

SEQ ID NO: 115436 - DNA, 1083 bp, Homo sapiens
  Payload ID: 2531
  Gene Symbol: CD209
  Gene Name: CD209 molecule
  Uniprot ID: Q9NNX6
  ENST ID: ENST00000204801
  CDS Start-End: 1-1083
atgagtgactccaaggaaccaagactgcagcagctgggcctcctggtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtag

SEQ ID NO: 115437 - DNA, 1143 bp, Homo sapiens
  Payload ID: 2531
  Gene Symbol: CD209
  Gene Name: CD209 molecule
  Uniprot ID: Q9NNX6
  ENST ID: ENST00000315591
  CDS Start-End: 1-1143
atgagtgactccaaggaaccaagactgcagcagctgggcctcctggaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtag

SEQ ID NO: 115438 - DNA, 4283 bp, Homo sapiens
  Payload ID: 2531
  Gene Symbol: CD209
  Gene Name: CD209 molecule
  Uniprot ID: Q9NNX6
  ENST ID: ENST00000315599
  CDS Start-End: 24-1238
acactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccatttggctgtttctaagttgtattctttattttattattattattactatttttcgagatggagtttcactcttgtcgctcaggctggagtgccatggcgcgatcttggctcactgcaacctctgcctcccgggttcaagtgattctcctgcctcagcctcacgagtagctggaattacaggcaggcgccaccagacccggctaattttttgtatttttagtacagatggggtttctccgtgttggtcaggctggtcttgaactcccgacctcagatgatctgcccgcctcggcctcccaaaattgctgggattacaggtgtgagccaccgcgcctggcctattattttttgtaagaataaaacaggtttattgggatttgggactctgaacagttctgtctctactacctgatctcctcctaccacgactttgggatctagaggagctttggctccggctgtgacggctccggccgttctcactgcggctgcaccggcccccgctgcggtcactatttcttcctctgctaggtgaattgtgcctctcctggctctttgacatgtgctagtgagatttcttccttttcctttcggattccccatttcttttgtaggaatggtctggactagggttctccttccccgcagcctgtagtattcatcgtggtggcccaccctctctctccccttggagctcttgccaaaggaggagacaagcagaggtctctattggatttctcaacacctgaagaaagttgcagtgttttcctcttggacattgttgtatttcaaataaaccacaaatcatcattttccaccgagccactgggcagaattcacactgaagctgtcgtcctgcgtacataccatcgtccgttaaacagagaaagagctgcttggcattcttcttccgactggtactgaacatatatacttgcccctcaggtgaggttccaagttgcaactgaccttgaactgaatcactctccccacgttattttttaattactatttttttttaaagatggggtcttgctctgtcgccaggctggagtgcagtggcgcgatctaggctcactgcaacttccgcctcccgggttcaagcgattctcctgcctcagcctcccgagtagctgggactccactaaaagtacaaaaattagctgggcgtgcaccactgcgcccagctaattcttgtatttttggtagagacggggtttcaacatgttgaccaggatggtctcgatctcttgacctcgtgattcgcccgccgcgtcctcccaaagtgctgggattacaggcctgagccaccgcgcccagtctctccccacgttcttgaactcgggcagcacatcctcacagaaatctaggaactgttggtaggtttcttcctcgctgtactccaggcttgcttcggagtcatagtcatccctcctgcactgctcctttccaaacactgtaaacatgcttttaataagaagggtaggactggatgttgggaaatcatgtgaacatctatctccaaatctgcaagctcctgttttactgtagaagggacaattaactccatccttctccatgactctgaaatccaagggggggttccgggttttgccatgtggcgccattttccaactcattttcagcctgatccagcatcttctggacagcttccggtttttgtttcttctgtcgtttctgttcctcctcctctctctctttcctctgctgttcttcccattgttcctttaactttcgctcttgttcttgccgttttctagccacctcttccttttccttctttattctgaattcttcttgtgccttctgctctctcagcaaccactcctcatgtaatctttgcctctctcttccccatagcttttctagttgttgtttttcaataaaagtgtcctcctctttctgtgagagtcctgagtccctcagtggagcaagttcctgctggcgtttctttcgtttctccttcttcagggcggccctgtactttttgtggcttggtttctctggaaatgtcaccttttcgggcgcagccatcttgccggcaccgccccgcccctctagttgtatcctttataataaactggtaaacattgtaaccgcagattcagcccaatctggttcaactttgtgtaataaaatggcgagttgtttttcagttgtcgtggacccccaggttgcaagttacataccctgggcatgtccagatgaacgaagcgtgcaaatccacgtggaacctaagtgctcagaccgaggaacagggactgagttaagaagtggacaccacgtggcatgatccttgatccaatcagattgagccctggcgtgatccagtcagatcaagcctcctgaatcccctcattacaagatccaatcatatcatgcctcactaccctctgtatataaaatctgccccagcctccaacttggagagacagatttgggccagactcctgtgtccttgcttggctgccttgcaataaatttttctctctacaaa

SEQ ID NO: 115439 - DNA, 1197 bp, Homo sapiens
  Payload ID: 2531
  Gene Symbol: CD209
  Gene Name: CD209 molecule
  Uniprot ID: Q9NNX6
  ENST ID: ENST00000354397
  CDS Start-End: 1-1197
atgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtag

SEQ ID NO: 115440 - DNA, 507 bp, Homo sapiens
  Payload ID: 2531
  Gene Symbol: CD209
  Gene Name: CD209 molecule
  Uniprot ID: Q9NNX6
  ENST ID: ENST00000394161
  CDS Start-End: 1-507
atgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtag

SEQ ID NO: 115441 - DNA, 1313 bp, Homo sapiens
  Payload ID: 2531
  Gene Symbol: CD209
  Gene Name: CD209 molecule
  ENST ID: ENST00000394173
  CDS Start-End: 54-785
aataaaagctgtggcccccaggagttctggacactgggggagagtggggtgacatgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgcaagagctcattttgcaggctggaagcaccagggaattaattcccccagtcaaccaatggcacccagagagggcatggaggctccacgcaaccccttccacccccacatcttcctttgtcttatacatggcttccat

SEQ ID NO: 115442 - DNA, 1439 bp, Homo sapiens
  Payload ID: 2531
  Gene Symbol: CD209
  Gene Name: CD209 molecule
  Uniprot ID: Q9NNX6
  ENST ID: ENST00000601951
  CDS Start-End: 108-1250
gggtgacatgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatg

SEQ ID NO: 115443 - DNA, 1497 bp, Homo sapiens
  Payload ID: 2531
  Gene Symbol: CD209
  Gene Name: CD209 molecule
  ENST ID: ENST00000593660
  CDS Start-End: 101-1105
atgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtagcagaacttcacccccttttaagctacagttccttctctccatccttcgaccttcacaaaatctctgggactgttctttgtcagattcttcctcctttagaaggctgggtcccattctgtccttcttgtcatgcctccaatttcccctggtgtagagcttgtttttctggcccatccttggagctttatgagtgagctggtgtgggatgcctttgggggtggacttgtgttccaagaatccactctctcttccttttggagattaggatatttgggttgccatgtgtagctgctatgtcccctggggcgttatcttatacatgcaaacctaccatctgttcaacttccacctaccacctcctgcacccctttgatcggggacttactggttgc

SEQ ID NO: 115444 - DNA, 994 bp, Homo sapiens
  Payload ID: 2531
  Gene Symbol: CD209
  Gene Name: CD209 molecule
  Uniprot ID: Q9NNX6
  ENST ID: ENST00000601256
  CDS Start-End: 101-994
atgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggatacaagagcttagcagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtgggtgagcttccagagaaatctaagatgcaggagatctaccaggagctgactcggctgaaggctgcagtgggtgagcttccagagaaatctaagcagcaggagatctaccaggagctgacccggctgaaggctgcagtgggtgagcttccagagaaatctaagcagcaggagatctaccaggagctgacccggctgaaggctgcagtgggtgagcttccagagaaatctaagcagcaggagatctaccaggagctgacccagctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagcttcaagcagtattggaacagaggagagcccaacaacgttggggaggaagactgcgcggaatttag

SEQ ID NO: 115445 - DNA, 939 bp, Homo sapiens
  Payload ID: 2531
  Gene Symbol: CD209
  Gene Name: CD209 molecule
  Uniprot ID: Q9NNX6
  ENST ID: ENST00000602261
  CDS Start-End: 1-939
atgagtgactccaaggaaccaagactgcagcagctgggcctcctggaggaggaacagctgagaggccttggattccgacagactcgaggatacaagagcttagcagggtgtcttggccatggtcccctggtgctgcaactcctctccttcacgctcttggctgggctccttgtccaagtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtag

SEQ ID NO: 115446 - DNA, 807 bp, Homo sapiens
  Payload ID: 2531
  Gene Symbol: CD209
  Gene Name: CD209 molecule
  ENST ID: ENST00000593821
  CDS Start-End: 1-807
atgagtgactccaaggaaccaagactgcagcagctgggcctcctggtgtccaaggtccccagctccataagtcaggaacaatccaggcaagacgcgatctaccagaacctgacccagcttaaagctgcagtgggtgagctctcagagaaatccaagctgcaggagatctaccaggagctgacccagctgaaggctgcagtgggtgagcttccagagaaatctaagctgcaggagatctaccaggagctgacccggctgaaggctgcagtgggtgagcttccagagaaatctaagctgcaggagatctaccaggagctgacctggctgaaggctgcagtggaacgcctgtgccacccctgtccctgggaatggacattcttccaaggaaactgttacttcatgtctaactcccagcggaactggcacgactccatcaccgcctgcaaagaagtgggggcccagctcgtcgtaatcaaaagtgctgaggagcagaacttcctacagctgcagtcttccagaagtaaccgcttcacctggatgggactttcagatctaaatcaggaaggcacgtggcaatgggtggacggctcacctctgttgcccagcttcaagcagtattggaacagaggagagcccaacaacgttggggaggaagactgcgcggaatttagtggcaatggctggaacgacgacaaatgtaatcttgccaaattctggatctgcaaaaagtccgcagcctcctgctccagggatgaagaacagtttctttctccagcccctgccaccccaaacccccctcctgcgtag

SEQ ID NO: 115447 - DNA, 3268 bp, Homo sapiens
  Payload ID: 2532
  Gene Symbol: CD22
  Gene Name: CD22 molecule
  Uniprot ID: P20273
  ENST ID: ENST00000085219
  CDS Start-End: 67-2610
agatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttc

SEQ ID NO: 115448 - DNA, 2106 bp, Homo sapiens
  Payload ID: 2532
  Gene Symbol: CD22
  Gene Name: CD22 molecule
  ENST ID: ENST00000270311
  CDS Start-End: 26-1969
caggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagac

SEQ ID NO: 115449 - DNA, 2755 bp, Homo sapiens
  Payload ID: 2532
  Gene Symbol: CD22
  Gene Name: CD22 molecule
  Uniprot ID: P20273
  ENST ID: ENST00000341773
  CDS Start-End: 85-2097
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttc

SEQ ID NO: 115450 - DNA, 2642 bp, Homo sapiens
  Payload ID: 2532
  Gene Symbol: CD22
  Gene Name: CD22 molecule
  Uniprot ID: P20273
  ENST ID: ENST00000419549
  CDS Start-End: 383-2410
ggaagacacgcggaaacagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttcca

SEQ ID NO: 115451 - DNA, 2698 bp, Homo sapiens
  Payload ID: 2532
  Gene Symbol: CD22
  Gene Name: CD22 molecule
  Uniprot ID: P20273
  ENST ID: ENST00000544992
  CDS Start-End: 42-2297
ggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaagagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttcca

SEQ ID NO: 115452 - DNA, 3004 bp, Homo sapiens
  Payload ID: 2532
  Gene Symbol: CD22
  Gene Name: CD22 molecule
  Uniprot ID: P20273
  ENST ID: ENST00000536635
  CDS Start-End: 67-2346
agatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttc

SEQ ID NO: 115453 - DNA, 603 bp, Homo sapiens
  Payload ID: 2532
  Gene Symbol: CD22
  Gene Name: CD22 molecule
  ENST ID: ENST00000600131
  CDS Start-End: 170-603
cttttgctctcagatgctgccagggtccctgaagagggaagacacgcggaaacaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctggaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagct

SEQ ID NO: 115454 - DNA, 559 bp, Homo sapiens
  Payload ID: 2532
  Gene Symbol: CD22
  Gene Name: CD22 molecule
  ENST ID: ENST00000599811
  CDS Start-End: 67-559
agatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgatcctcccaagaaggtgaccacagtgattcaaaaccccatgccgattcgagaaggagacacagtgaccctttcctgtaact

SEQ ID NO: 115455 - DNA, 554 bp, Homo sapiens
  Payload ID: 2532
  Gene Symbol: CD22
  Gene Name: CD22 molecule
  ENST ID: ENST00000598537
  CDS Start-End: 237-554
gtccctcccggtctgccaacctcctgagtcactcctgacggagatgactgatccatccctggcccgcctcccaccctgtccctgggacagtgcctggggcaggcagctccattatcctccttgatgaaagagctcccagccagcactggccactccagagcctcctccccagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatc

SEQ ID NO: 115456 - DNA, 2107 bp, Homo sapiens
  Payload ID: 2532
  Gene Symbol: CD22
  Gene Name: CD22 molecule
  Uniprot ID: P20273
  ENST ID: ENST00000594250
  CDS Start-End: 26-2038
caggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagac

SEQ ID NO: 115457 - DNA, 3060 bp, Homo sapiens
  Payload ID: 2532
  Gene Symbol: CD22
  Gene Name: CD22 molecule
  ENST ID: ENST00000601769
  CDS Start-End: 67-642
agatgctgccagggtccctgaagagggaagacacgcggaaacaggcttgcacccagacacgacaccatgcatctcctcggcccctggctcctgctcctggaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctg

SEQ ID NO: 115458 - DNA, 567 bp, Homo sapiens
  Payload ID: 2532
  Gene Symbol: CD22
  Gene Name: CD22 molecule
  ENST ID: ENST00000599717
  CDS Start-End: 88-204
tgtacttctccttttgctctcagatgctgccagggtccctgaagagggaagacacgcggaaacaggcttgcacccagacacgacaccatgcatctcctcggcccctggctcctgctcctggtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatc

SEQ ID NO: 115459 - DNA, 740 bp, Homo sapiens
  Payload ID: 2532
  Gene Symbol: CD22
  Gene Name: CD22 molecule
  ENST ID: ENST00000594349
  CDS Start-End: 1-447
gttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatg

SEQ ID NO: 115460 - DNA, 542 bp, Homo sapiens
  Payload ID: 2532
  Gene Symbol: CD22
  Gene Name: CD22 molecule
  ENST ID: ENST00000600424
  CDS Start-End: 67-542
agatgctgccagggtccctgaagagggaagacacgcggaaacaggcttgcacccagacacgacaccatgcatctcctcggcccctggctcctgctcctggaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgatcctcccaagaaggtgaccacagtgattcaaaaccccatgccgattcgagaaggagacacagtgaccct

SEQ ID NO: 115461 - DNA, 831 bp, Homo sapiens
  Payload ID: 2532
  Gene Symbol: CD22
  Gene Name: CD22 molecule
  ENST ID: ENST00000593867
  CDS Start-End: 155-831
agatgctgccagggtccctgaagagggaagacacgcggaaacagatacccagcagcctttggcatgagccatgtggcccgaggagataaacagacagagagaggaacattgatgcgtgtgaaatgttggcaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgg

SEQ ID NO: 115462 - DNA, 558 bp, Homo sapiens
  Payload ID: 2532
  Gene Symbol: CD22
  Gene Name: CD22 molecule
  ENST ID: ENST00000595780
  CDS Start-End: 159-558
agatgctgccagggtccctgaagagggaagacacgcggaaacaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacc

SEQ ID NO: 115463 - DNA, 592 bp, Homo sapiens
  Payload ID: 2532
  Gene Symbol: CD22
  Gene Name: CD22 molecule
  ENST ID: ENST00000597916
  CDS Start-End: 180-592
agatgctgccagggtccctgaagagggaagacacgcggaaacagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctggaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggcc

SEQ ID NO: 115464 - DNA, 954 bp, Homo sapiens
  Payload ID: 2532
  Gene Symbol: CD22
  Gene Name: CD22 molecule
  ENST ID: ENST00000594125
  CDS Start-End: 1-438
aatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaag

SEQ ID NO: 115465 - DNA, 609 bp, Homo sapiens
  Payload ID: 2532
  Gene Symbol: CD22
  Gene Name: CD22 molecule
  ENST ID: ENST00000613136
  CDS Start-End: 1-462
catatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaaccta

SEQ ID NO: 115466 - DNA, 12319 bp, Homo sapiens
  Payload ID: 2533
  Gene Symbol: CD226
  Gene Name: CD226 molecule
  Uniprot ID: Q15762
  ENST ID: ENST00000280200
  CDS Start-End: 270-1280
gctatctgaggaagttctggtagagagaagagctcaagagcatgggcagagtcagctcctgagtgggctgaacgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaaggacaatggttattgttaaatatagtgatcattcatgtctaaaagattcattatttatctctaaagatttctaaagaccaccatctagaaaagattcattatgaaggctgtatttaaatatcaaagttgtggacttcatgataatcttaaataaagcaaatccaaattctcctgttgcctagacagattctaagatgtaatttacacttttaagctaattagtgagtattttatgattttagccttaaacaccatgtatgccaaataatgcacttgttttgtgaattacagaaatggtaagtgcccacatttctgtgaattataaaatttgtgagtttcttttaacccttttcaggagtgaaaaaataaaaacgaccatttcctggttgtgcttaagtatatgcaagaagggtaaactctcatttttattatgtttgcttaaagatctttttatacctggattcatgaaatgtttccacaaatatattagtgtaacaaacttgaaaggcagtttacaagaaagcactctactatcagatcaatcaaagattctgtgagtgaatttattggtttgcatggtgaagcaagcttagcatcaattaaaaggtaaataatttcttttctgaatggtaaagacaatcaaaatattactttctggaaaactccaataaccaaattctcaatgattagtgtatgtgagcaggaaaacatttttacagttgtagtatggggaaatataaatccaattttaagagagaaaattatgactgggtgtggaagggacagtatagtcagataccattgtcatggtggtttttactgggaacttcatgaaagacttttgtagcaaaccactgcagtattgcaaagcctccagaacatttggaacttgtctctttttccttgtgtgtgtttgtgtttttggtctctcattcaaaatattgatgagaactatttactctgtcctttcttctctatatattcttcctctacagagtgtagggttttttcaggaatttggagccatctgaagtcctcccaaaaattctctgacgtcttctgatgctcctgttataccctcaggggtaatgcttgtgaaattccattcattcattttctttctctggacatctttacttaccaaagcactttcattgtcatctttttaacatcattcttaattcgtgatagttttgggactctccctagtgtatgtttctccccctctactcttttgcacctatgattctgattgttactaagaaagcagatgaaaaacagatccacagaataaacgatcagaattccagtaaattctattttaaatacagatactttttacaagttgctgctttggaagcaaaatgcttcttaagttttacatatatatatatatatatacatatatatatacacatataatttatatcgatggataatacattaagaatctatgcttcctttgaatgccattaatatttatgttaaagtaaccaatgaaaggaaattactttgttataataagataggaagacttgttaatggagtacacagttttgtcagggaaagaacacatcttattgaactatgatgactatgcattgactatattattataagagataccttcaaactttatttaaagaactttaggtataatatgttgagaaaataaaatagaaatttcatttacttgtaatcatgcttaaaatgggaggcaggtaggtgaagatataatttttagtaaaaactccaatttatgttttaagtaattcagtgtattactaaaatactatatatataaacttaaaatacatgggttatcaatttaaaagacaaagtaagtaaaaatacttttagtaggcattcgtggattgtgaacatccaagttatattggtttgtatagaatggcattaagtaaaaattacagctgtataacagtagttttctaaattgagagagtccacattgtaattagagatcactgtgaccaaaatgcttctccttgatttataatgatgtactgtattttgtactgcttatatgaaatttcagcaagattgacgatattataaagatgcttataaagtgtaagtggagacgctaaattgtgagtacaaagtttctttttcacaacagtgataagaaaatatctttaaaaaatataagacaatataaacatgtcatcattagtttagctactattaaaatgtaacatctagaaagtactgatctccaccttcagacttctgtataagtatattttttcactgatctgttcattagagttcttccagccaagactctgggctcttaaaacatgtatctgaaaactaaaaacaagttaatttttttaaaagcttctctatttctagtgattcaataggtagaaaaatagcttctagaattaactgcaatgctttctaaggaaattttataaatcctcaaggtcggtttacacatatttttccagattcagagcactaactatcttgtaagatgtaagaaaaggtccatttggaagtatgagtaataaatgtctgggataattctggtttatttcgtattatccttgttagaataagttatatggtcaacctgttcagaacactttttctagtgttagtgtgtacttttggatttttggttcttgtagggtatagaaatattttcctttgtcttgtattctgttgttttgaatgaataaaacacaatgtttcacgatcactactttcatttgccatggagaaatagcagggaaaaatttctacagaataaaattaactgatgaattacatgcagaaaaaattcaaatcaatgatacattgtaatttttatctcaatgcaatgttctttgtattttattttattattatttttttgagacggagtttcacttttgttgcccgggctggagtgcaatggcacaatctcggctcaccacaacctctgcctcccggattcaagtgattctcctgcctcagcctcctgaatagctgggattacaggcatatgccaacatgcctggctaattttgtatttttagtggagacggggtttctccacgttggtcagacttgtcttgaactctggacctcaggtgatccacctgcctcagcctcctaaattgctgggattacaggcatgagcgaccactcctggccttgttctttgtattttataagtgcatgtagtgcaaagggtcaaagggctttacaggttttttgtttgtttgtttttgtttttcccgaaacatagtagtcccttgcccttcctcatttttgttaccttgagacaacaaattttactacttctaactcattattttatttatgttcacttttctgaatagcatgcttatgacactaatactttttttttcaattttagacattcattattcatttagatgtctttctctccccaaactcaccacataaaatactcttctcatgtctctttcagaaatatttgtattaaaatatgattatatcaatatttggcatttatttcttatgaccttgccagtactcttagttaaactacatggtaaaaatgattttgctttccctcctacataactttttttccacctagagctaataattgtcattctggggactgactttttctgtatttaccataaattgacctgaaactcccctgtgatgcagcaggaattctaccaacgtcaacttccttagaaagactccattagaagcttgacttggggctagaaggagaggcacacaactgccatcctggtgtctcccttcatccagaaaaagggggaggaatacatgaaacctagaatccactctaaaacattttccagaacaaaaggacatgtgtttccgtgttgtaaatgtttaacgagtgcccataacaaggaataataagtctattatgtttgcttttgtgtctgtaaaagttgggggtattggttgtaagcacgaaaacagatactgactgttgaagaaaaaaaaaaatacgaggtcaggagtttgagaccaacttggccaatatggtgaaaccctgtcttagtaaaaatagaaaaattagccaggcctggtggcacgcacctgtagtcccagctacttgggaggctgaggcagaagaatcgcttgaacccgggaggcagaggttgcagtgagccaagatcgcaccactgcactccaccctgggcaacagagcgagactccgtctcaaaaaaaaaaaaaaaaaaaaaaaaaaaaagttaagtatttgaacataggggtggctcatagaattcccaggacacccgatggagtaggcttgcaaaacacaacatgtggcaactccagtgggaaacgaggcaggaaacactcgtttcctgcagaaagcaacaatttgggcttcgataccctccctagaacacagggcagtgaatctgagcagcatcagtaccccacgttcggatgagtcctgagcccctatttttattcactgacttattccaaaatcagtgtctcttaaatatatctggaaggcagcagcttgtatctcccccttcagcttccatagtggcagtcagggtacaacttactttccaaacagaacacactgcgacattccctccaggctcgttgaagaacttcaactgacaaatgtccctcctcgaccagatgatagttttcttaaaggcagggtttaatatacccttttataaatgtttcaaggccctgtgtaatacctgagtttattccagatgtaactaaatatatccaagattgttttaaaataaattgctgaaaaaacaaataaatacagttagtatctatatcaatattctcagttggcagttttgcaataatggccgatagttcatttttagtaacactattgacattgcatttggatattagggtttactaatcatccgcatgtatacattgcatatttttctagactttaactttattcaaatctattgatttttaaacctgcaacttatgtctagacacaggtatacctttacaagaactaccattttttttggtaacatactacctccaaaatttcaagtaagaagttgatttttgtccatttttaaatggaaaacttgtaatcaaaatgccacaaaattatactgtgtatcatttgacctatagaaaccaatattattacaggaagaaagcagagccaatcttctacctgtggtcaaataagtggaggccctttctagactaagttctcatgagtttaaaataccaagcataagttctccaaattcctgaaaaggaagccttgtgttgtattgcccagccatatttgtaagacataaaaataaaacttgagaagaagctatgataacttactttcttcattcttcaaaatttacataatctcaactgattttatgtttttatgaaaatgcattcttaagatatatccttattcaatcatgtattcattacatcctttatgccaggtatccaaaagtacttacagtgactaagaccattattctttgatcagctgcctgagtaagactttgagctctccaatatactctcagtgatactaagttttctgagtaacagctttggatgtggcttcagttgagctgatttatcccacactttatttttatcgtataatggtcctcagaagcaaattttgattttagctcacataaaaaatgtacaaagaaatgtaatggctcagtagcttctagagatagagattactcttctaacctttctgtaattttgtatgtctattttataattctttcaatgtctaatgaatagctatctttttttgagacggagtctcgctctgtcgcccaggctggagtgcagtggtgcgacctcggctcaccgcaagctgcgtcttccaggttcacgccattctcctgcctcagcctcccgagtagctgggacttcaggcgcccaccaccatgcccagctaatttttttgtatttttagtagagacggggtttcaccgtgttagccagggtggtctcgatctcctgacctcgtgatccgcccgcctcggcctcccaacgtgctgggattacaggagtgagccaccgcgcccggcctccttagtttcttaaggtggaagcctagattattgattttatatgttgttttcttttccaatagtggcacttaatgctataaatttcactttgttccacaagttttggtaagctctatttttattttcatttagtccaaaatattttaaaatttcttttgatatttcttctttgagccatgaattatttacaatgtgttgtttaatctctatatattttgggatttttctactttatatctcttacagatttctaacttaatttcatcatgttttaaaaacattctttgtataatttctattcttttaaatttttcaggtgtattttatggcccagaatatggtctatcttgtagaatgtttcatgtgatcttaagaagaatgttcattctgctgttgagtgtaatattctacaaatgtccattagattaaactgattgataccaccgttcagattatctatatcctttctgattttccctcttcttgatctatcacatactgacagatcaagtgatcaagtctcgttaaagactgcaagtaaaatagtggatttttctatttctccttgcagttttgttagtttttgtctcatgtatcttgatactcttgttagtacatatactttcagaatcgttaggttttcttggagaattgacccctttaccacatgtaatgtcccttttattcttgataatctttcttgttctgtctgctttttctgatattaacataactttcagttttttaaaaaattaacattagcatctcacatctttatccttttaattttaaattatctaaatatttatatttaatgtgcctttcttatagacaatgtatagttgcgtctatttgtaatttccccacttttcttacttaaaaatgttgtagatatataggagttgtatatatttggggggtacatgtgatgttttgatacctgtatacaatatgtaatgatcatattgggtaatcgtgatatctgtcacctctaacattcatcttttttgtgtgtttaaacccaccacttctaattggtacatttagattattcaaatttaagtgattattgatatagttggattaatatctactatgtttgtaacttttctatccttgcactcgttctttcttttttatcctcctttttctgtgttctctgattttaactggggtttttacatgatttaattttctctcgtggcatatctttcattgatcaacctaggtttttctccttttcccctcttttttttggtatttattctatttagtgttatctgagctacctgagttggtgtctatcactaattttggcaagttcccagacgttattacttctaacattcttttgctccattctttcttcttcttcaattattccatagtcttgaatattctgggtttttcccactctttgaattttagtttgaaaagtttctattggcctagcttcaaagtcattcattcttccttcggggttccaagtcaactgataattgcatcaaagatatccttcctttctattactatgttttttattgctaccatttcttttttattccttcttagtgtttccatctttcttcttacattatccatctgttgtctatttttttcatgagagctcttaacatattaatgataagttccatgtctgataattctgacacgtgtcatgtctctatctggttccaatgattgctttatctcttcagaccatgacttttcttgccttttgacgttctttgacattttttttgaattttttgttgcaagccagatctggtgtgttatgtaataggaacaggtaaataagtctttagcttgcagacttatcttaatctgactaactattagactgtgtttaaagtctgttataaccataggtgctaaatttcttcaaattcctctagtgtctttgttttgtttgttcatgtgtttttccccttcttgagttcaggcttccctaagtgctcctcttcagagagactttctgtctttcagctctttcctctgcaattcactgttactatactggagccctgttggtgtagtactaagctgtgggaaaggagagtgctctgtaatcttacagtgaaatctcagtcttttagtgggtctgtgtctgggacattcacagagcttctccagtggtattgcttcctcatcctcaactctctttcctggctgcagcattcccaatgtatttctttgaaggcctgccccctgttgactgttattttccctctttccttaagtgggacagggagacttcaggggctgggatgaggtttgggaattgtgcttggcagagtcctttccatctttgttaccaagaaggttcatggcttatttctcaatggatgtccctctctatctgttgccagagccacgaggaaatttttcttggatcctcataatgagaaccttggagtttcctactggaaaagcccttgaatgtgtggagtgcctcaagagcacagcccccatgggtttcttgctcacaccagtccacaaacagatgccagcaattcacccaacttaccatataaaggctcatactagtttatggctccagtgctttgactccagataaatggctattggttgcgtatctctctggatgtatctgtatctccagattttggggtggcagtttgctcaggaccttggttctctaataggtctaataagaaaagtcattgattttcagctttccaactttccagctttgtcttgttataagcatggcagcaacatcttccatgccttaacatgatgacactaaaggcagaagtcgatctccatgtataaacattttaacacatatgttttttgttatcgtggtttctgacctgtctctttgccctgactttctgatactgcactagggttcctgttgctggactccattccatatgacttgctctcgtctaggctgctctttggctcatctttataaatcatgatccaaaatgaagcacatatttattttttaaataaatatgaaatgaagtatagacatcaaactgaagatgagtagatcatactgagtttcactgtctgtgcttggatcaacatcaggccttatacaaatattcaagtccagaggcaaaaggtaataaggaaaatttgtagcacaagccacaaggagataacatgtcaagtctatgcgattggaaataaactaaagatgaactgctggggatgctcactcatcacagagctcagtctaaagcaccagatttcacaagcattttttgggggaaattctgttaaaatgaaatatgagtcacatggtggtgtttcactcatcatatgtgttcaatattaattcattttaaggtttagttgcacaaaaggtaaatgagaattagaagactccatgggtaagaggagccacagaagtaaagcattgtcaagggttctatgtctatatatttagatattaggcttctgagaaaaaaacacaataggaaggaagatgaacacaacagagggcagaaggtctatacgtcctgaggccttttatgcaacgtttgtttgtggaatgttttttaagaatgtgtgagagtcattttaatgtgaaataaagacctacgtctac

SEQ ID NO: 115467 - DNA, 1458 bp, Homo sapiens
  Payload ID: 2533
  Gene Symbol: CD226
  Gene Name: CD226 molecule
  Uniprot ID: Q15762
  ENST ID: ENST00000582621
  CDS Start-End: 448-1458
atgcatgcaccacctttcacttattatttatatttttacatctttattttagtttctgcctcctccacatagaatgtaagttctatcatggcaatatttttttttttttgtattattgtatcctcattgcctacagctgagttaggcacagagaatgcatgcagcacatgtttgttgaatgaatgactccttgtagaaaatgaaagcccgaaaataagccgactggttccccgagagagaagaaactcaaatctgcccatcctcataaaggagcaaacctgtcttttaagctaaggcctttttcctgtgttcatacttcagaaaaagaagacacgactgataacatctgagaggaaggaaactgcattgtgctggggatctgcatgtcacattataaaaagcaatttttttttttaatagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaa

SEQ ID NO: 115468 - DNA, 1009 bp, Homo sapiens
  Payload ID: 2533
  Gene Symbol: CD226
  Gene Name: CD226 molecule
  ENST ID: ENST00000577287
  CDS Start-End: 265-810
acagtttccagagatggattatcctactttacttttggctcttcttcatgtatacagagggaacttggcagaaggtgatacaggtggttcagtcaggacaaccaattgaaaacagctcaacctttcaggatagaggatggagctaacctgtagagaactaaatgatggttgttatgcaaagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttat

SEQ ID NO: 115469 - DNA, 474 bp, Homo sapiens
  Payload ID: 2533
  Gene Symbol: CD226
  Gene Name: CD226 molecule
  ENST ID: ENST00000578928
  CDS Start-End: 1-114
atcgtcatccccgatgtcacagtctcagactcggggctttaccgctgctacttgcaggccagcgcaggagaaaacgaaaccttcgtgatgagattgactgtagccgagggttaaatggaagctgatcggcgttcacatggaatcctcctcacgtagctcagatggatggccacagggagcaacattgtcagcaacaaggaaacgctcaccagaaagacaggattgttcgctgttagtgtatagaaacactactgacaggccataatgaataatgagattgaaggagtaataaaagtcttccaccaaagaaaagcccaggacctagtggaatcactgccaacctttgcctatcagtaataccagtttcacttaaactatttcaaaaaattgaagaggagataatacttccaaacctactctatgagacatcagagctccaggcctttggactatgggacctacaccattggcttt

SEQ ID NO: 115470 - DNA, 930 bp, Homo sapiens
  Payload ID: 2533
  Gene Symbol: CD226
  Gene Name: CD226 molecule
  ENST ID: ENST00000580335
  CDS Start-End: 549-930
tagaacaaaggagaagtgcgtcctttcaaattatagattctttgggggaaaagagggacagaactttatctgagtttggaatgagtctgagtagctgcaatagtaaagttgcttccagaagcaggtaaacttgacttcaaaaaaccccgcttcatgaaatattagtgattcacttcagttgctatctgaggaagttctggtagagagaagagctcaagagcatgggcagagtcagctcctgagtgggctgaacgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagaaaaagaagacacgactgataacatctgagaggaaggaaactgcattgtgctggggatctgcatgtcacattataaaaagcaatttttttttttaatagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcag

SEQ ID NO: 115471 - DNA, 1168 bp, Homo sapiens
  Payload ID: 2533
  Gene Symbol: CD226
  Gene Name: CD226 molecule
  ENST ID: ENST00000579496
  CDS Start-End: 339-1168
tcatttagaaaaattcccaaagaagaacttagcacttacccgggcctgatgcttgaggtctggagtccttaaggtgtgtgtgtaagtacttatttccttgaaaccttgagaccctcaagagagggggactaaaaacagtggaggaagaaaagaacagtggccaagggagtcgtgggtgaagtttgctgggcccttggcaatgctaaaaccagaaaaagaagacacgactgataacatctgagaggaaggaaactgcattgtgctggggatctgcatgtcacattataaaaagcaatttttttttttaatagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacag

SEQ ID NO: 115472 - DNA, 2157 bp, Homo sapiens
  Payload ID: 2533
  Gene Symbol: CD226
  Gene Name: CD226 molecule
  ENST ID: ENST00000581982
  CDS Start-End: 254-799
cgctcccctcagctcctgcagtgctaattaagggagggagcagcggggagcttgcagtgaccaagagggtgttgaggctaggaggccacgataaacaggatacgataaaagtccttaaccaagacgcagatgggaagaagcgttagagcgagcagcactcacatctcaagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtttaagcttattcttgacatgagtgcattagtaatgactcttatgtactcatgcatggatctttatgcaatttttttccactacccaaggtctaccttagatactagttgtctgaattgagttactttgataggaaaaatacttcattacctaaaatcatttttcatagaactgtttcagaaaacctgactctaactggtttatatacaaaagaaaacttactgtatcatataacagaatgatccaggggagattaagctttgggcaagggctatttaccagggcttaaatgttgtgtctagaattaagtatgggcataaactggcttctgaatccctttccagagtgttggatccatttccctggtcttggcctcactctcatgcaggctttcctcttgtgttggcaagatggctgccaactcttggcaattcatacatccttgtttctgtctggtagagagtttgcttctcaaatggagcaaacaaatttgattattttttcattgttaaataggcaacatgaccagaaaggatggaatggcttaagtaaactaagggttcacttctagagctgagaagcagggtcaaagcacaatactgggcaattcagagcatggttagaagaggaaaggggagtctcaaagctggagagtttaccaacaaatattgactgcagtgattaaccaagacatttttgttaactaaaaagtgaaatatgggatggattctagaaatggggtatctctgtccatacttctagaatccactctatcagcatagtccagaagaatacctggcagtagaagaaatgaatattcaagaggaagataaatgcgagagggcaatcctttactattctcatatttatttatctctcattctgtatagaattcttgccgccatcccaggtctagccttaggagcaaatgtagtagatagtcgaataataaataacttaatgttttggacatattttgtctacttttgagaattatttttaatatgtaaattctctcaaaagggtcaggcacctagttattattttttaatgattatgtgaaagttgaatataatataccactaaaagtgacagttgaaagtggtggcataggacggtagggtagaaatttgggagggaaaaaagaaattgggagggtacaggcaacaggagaaaggaatcaaaccacagaaaaatacaaagggaaacttctgcttcactattcagacaaagacagccctaatgacatcaccaacagtcaaagcaattagagaccatacctaatattgtttaaattctagatgtaggctaacaatgaaaagtatttgccaaactgaataaaactgtcatggttaccttgaaa

SEQ ID NO: 115473 - DNA, 579 bp, Homo sapiens
  Payload ID: 2533
  Gene Symbol: CD226
  Gene Name: CD226 molecule
  ENST ID: ENST00000583955
  CDS Start-End: 184-579
agtgaaaccatggcaagttgatgcagcaggacaagagagttgccggaaaaagctggaaaaaagaagacacgactgataacatctgagaggaaggaaactgcattgtgctggggatctgcatgtcacattataaaaagcaatttttttttttaatagaaccagcctttcaaacagtttccagagatggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggca

SEQ ID NO: 115474 - DNA, 2180 bp, Homo sapiens
  Payload ID: 2534
  Gene Symbol: CD24
  Gene Name: CD24 molecule
  ENST ID: ENST00000606017
  CDS Start-End: 110-352
ggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagc

SEQ ID NO: 115475 - DNA, 586 bp, Homo sapiens
  Payload ID: 2534
  Gene Symbol: CD24
  Gene Name: CD24 molecule
  ENST ID: ENST00000620405
  CDS Start-End: 87-200
cccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttg

SEQ ID NO: 115476 - DNA, 566 bp, Homo sapiens
  Payload ID: 2534
  Gene Symbol: CD24
  Gene Name: CD24 molecule
  ENST ID: ENST00000619869
  CDS Start-End: 1-265
agatcgctccggacccggacaccgcctgcgaggagcgccgaccagccgggaagggttcgcgctaggcggcgcccgggtcccgtcggccaggatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaat

SEQ ID NO: 115477 - DNA, 1026 bp, Homo sapiens
  Payload ID: 2534
  Gene Symbol: CD24
  Gene Name: CD24 molecule
  ENST ID: ENST00000615659
  CDS Start-End: 1-368
ccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttgggggatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatga

SEQ ID NO: 115478 - DNA, 825 bp, Homo sapiens
  Payload ID: 2534
  Gene Symbol: CD24
  Gene Name: CD24 molecule
  ENST ID: ENST00000622315
  CDS Start-End: 155-544
ctttttaaacaaaccccggttccgggctgaagccgaggcggggaccctctcctgacgctgcgctctctgcgaggcaacctttcacgtccatcgcttgtcatcttaggatccccatgttattttagcccagattggctagttctggggaggcagcatggtgggacgattctgtcccgagtccccgccaggctttgttcgggtcgccgctaccagcgcggtctccctagatcctccatccggggaacctcgccccgggtgcgggtacccggggccgcgcagcgctgcctcgagggtgtatggatgcaccgcgccggcgagagagaccgggggctgggcctgggagaccctagcgggggcgggggcgaagaagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttcc

SEQ ID NO: 115479 - DNA, 802 bp, Homo sapiens
  Payload ID: 2534
  Gene Symbol: CD24
  Gene Name: CD24 molecule
  ENST ID: ENST00000610952
  CDS Start-End: 368-610
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggcttcggggagggcgcggccgcggggccgagcgcgcagatcgctccggacccggacaccgcctgcgaggagcgccgaccagccgggaagggttcgcgctaggcggcgcccgggtcccgtcggccagggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgact

SEQ ID NO: 115480 - DNA, 2513 bp, Homo sapiens
  Payload ID: 2534
  Gene Symbol: CD24
  Gene Name: CD24 molecule
  ENST ID: ENST00000619133
  CDS Start-End: 441-683
gcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 115481 - DNA, 921 bp, Homo sapiens
  Payload ID: 2535
  Gene Symbol: CD244
  Gene Name: CD244 molecule, natural killer cell receptor 2B4
  Uniprot ID: Q9BZW8
  ENST ID: ENST00000322302
  CDS Start-End: 24-845
cctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacagga

SEQ ID NO: 115482 - DNA, 1360 bp, Homo sapiens
  Payload ID: 2535
  Gene Symbol: CD244
  Gene Name: CD244 molecule, natural killer cell receptor 2B4
  Uniprot ID: Q9BZW8
  ENST ID: ENST00000368033
  CDS Start-End: 84-1196
gctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgaatctctgcttccagataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaacca

SEQ ID NO: 115483 - DNA, 2463 bp, Homo sapiens
  Payload ID: 2535
  Gene Symbol: CD244
  Gene Name: CD244 molecule, natural killer cell receptor 2B4
  Uniprot ID: Q9BZW8
  ENST ID: ENST00000368034
  CDS Start-End: 179-1276
ggccttgtcagctcacagcaggcgttaacagcctctaattgaggaaactgtggctggacaggttgcaaggcagttctgctccccatcgtcctcttgctgactggggactgctgagcccgtgcacggcagagagtctggtggggtggaggggctggcctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacaggagtctctatagaacagttcctagtctggagaggatatggaaatttgttcttgttctatattttgttttgaaaatgatgtctaacaaccatgataagagcaaggctgttaaataatatcttccaatttacagatcagacatgaatgggtggaggggttaggttgttcacaaaaggccacattccaagtatttgtaatctagaaagtgttatgtaagtgatgttattagcatcgagattccctccacctgattttcaagctgtcacttgtttccttttctcccctctctgggttgactgcatttctagactctcgccggcccaggcccatcttccaaagcaagaggaaggaatgataatggtgactcaggggaagaagaaacagccctcctctgaaagcctggactgtccggctgtgaactggctggcaggttctgcacgtgggtgggggccagggcctgggctttactcaattgcagagaaaaaactttctccctgcatctcatacctttacctctggccagttggccaccagggggagtgggctgaagggagagtagatggtgcaaagcaagcccatctctaagtagaaaaatcacccagagcacatgctgacctgataactggggtgttgagaccagctttgtccatggtatgatgtttgatttatgaagacgcattgttagaaatccatttggcttcttcatagaagtggcttcccagaggaagaggcctctcagaaaccatgttctatttaagttctgagtcctgatgagtgttccccaggatgcacattgaagggagggctcaggcagctgagggctgagaatgaggcagttggaatctagacactatgctgggttccctgagtcgtcaggccagacatttcaacaaggctgtggggagcagggctgtgactctggctgagcccaggaaagcgacaagggtgaactgggagaggacttactcagagaccccaacaggtgatactgcacaaagcctggttcttcaattttcctaccctgtatctaacataggagtttcatataaaacggtgatatcatgcagatgcagtctgaattccttgcctgaattaaatttatgtatcctctcca

SEQ ID NO: 115484 - DNA, 1341 bp, Homo sapiens
  Payload ID: 2535
  Gene Symbol: CD244
  Gene Name: CD244 molecule, natural killer cell receptor 2B4
  Uniprot ID: Q9BZW8
  ENST ID: ENST00000492063
  CDS Start-End: 24-1013
cctggcccctctgtcctgtggaaatgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagggtgacagattctattcattttctggctgagagtgcctcagaatttttctgggccctgagtctcttttgggacctctcacatcacttaggagtgggagagcacttatctcgaagttaagtattctttaccttctgaatttctagtctggatccaggaagaggaaccacagcccttccttcaatagcactatctatgaagtgattggaaagagtcaacctaaagcccagaaccctgctcgattgagccgcaaagagctggagaactttgatgtttattcctagttgctgcagcaattctcacctttcttgcacatcagcatctgctttgggaattggcacagtggatgacggcacagga

SEQ ID NO: 115485 - DNA, 1609 bp, Homo sapiens
  Payload ID: 2536
  Gene Symbol: CD247
  Gene Name: CD247 molecule
  Uniprot ID: P20963
  ENST ID: ENST00000362089
  CDS Start-End: 74-568
ttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctactctgctttttttctactgttttaatttatactggcatgctaaagccttcctattttgcataataaatgcttcagtgaaaatgca

SEQ ID NO: 115486 - DNA, 1678 bp, Homo sapiens
  Payload ID: 2536
  Gene Symbol: CD247
  Gene Name: CD247 molecule
  Uniprot ID: P20963
  ENST ID: ENST00000392122
  CDS Start-End: 146-637
tgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctactctgctttttttctactgttttaatttatactggcatgctaaagccttcctattttgcataataaatgcttcagtgaaaatgca

SEQ ID NO: 115487 - DNA, 2558 bp, Homo sapiens
  Payload ID: 2537
  Gene Symbol: CD248
  Gene Name: CD248 molecule, endosialin
  Uniprot ID: Q9HCU0
  ENST ID: ENST00000311330
  CDS Start-End: 18-2291
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaaccttacccaagg

SEQ ID NO: 115488 - DNA, 1338 bp, Homo sapiens
  Payload ID: 2538
  Gene Symbol: CD27
  Gene Name: CD27 molecule
  Uniprot ID: P26842
  ENST ID: ENST00000266557
  CDS Start-End: 230-1012
aatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 115489 - DNA, 3343 bp, Homo sapiens
  Payload ID: 2539
  Gene Symbol: CD274
  Gene Name: CD274 molecule
  Uniprot ID: Q9NZQ7
  ENST ID: ENST00000381573
  CDS Start-End: 109-639
ggcgcaacgctgagcagctggcgcgtcccgcgcggccccagttctgcgcagcttcccgaggctccgcaccagccgcgcttctgtccgcctgcagggcattccagaaagatgaggatatttgctgtctttatattcatgacctactggcatttgctgaacgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtt

SEQ ID NO: 115490 - DNA, 3644 bp, Homo sapiens
  Payload ID: 2539
  Gene Symbol: CD274
  Gene Name: CD274 molecule
  Uniprot ID: Q9NZQ7
  ENST ID: ENST00000381577
  CDS Start-End: 87-959
gcgtcccgcgcggccccagttctgcgcagcttcccgaggctccgcaccagccgcgcttctgtccgcctgcagggcattccagaaagatgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaa

SEQ ID NO: 115491 - DNA, 2738 bp, Homo sapiens
  Payload ID: 2540
  Gene Symbol: CD276
  Gene Name: CD276 molecule
  Uniprot ID: Q5ZPR3
  ENST ID: ENST00000318424
  CDS Start-End: 235-1185
ccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgt

SEQ ID NO: 115492 - DNA, 3469 bp, Homo sapiens
  Payload ID: 2540
  Gene Symbol: CD276
  Gene Name: CD276 molecule
  Uniprot ID: Q5ZPR3
  ENST ID: ENST00000318443
  CDS Start-End: 303-1907
ccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 115493 - DNA, 2439 bp, Homo sapiens
  Payload ID: 2540
  Gene Symbol: CD276
  Gene Name: CD276 molecule
  ENST ID: ENST00000537340
  CDS Start-End: 552-1718
cgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctgg

SEQ ID NO: 115494 - DNA, 547 bp, Homo sapiens
  Payload ID: 2540
  Gene Symbol: CD276
  Gene Name: CD276 molecule
  ENST ID: ENST00000560786
  CDS Start-End: 80-547
attcgggccgggcctcgctgcggcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcgg

SEQ ID NO: 115495 - DNA, 628 bp, Homo sapiens
  Payload ID: 2540
  Gene Symbol: CD276
  Gene Name: CD276 molecule
  ENST ID: ENST00000561260
  CDS Start-End: 133-628
gggcgaaggtgtgggcgactggtgcacttccacaggcagccgtgggcagcatgaggggtcagattccgggaaggacaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgct

SEQ ID NO: 115496 - DNA, 2690 bp, Homo sapiens
  Payload ID: 2540
  Gene Symbol: CD276
  Gene Name: CD276 molecule
  Uniprot ID: Q5ZPR3
  ENST ID: ENST00000561213
  CDS Start-End: 125-1726
cgggcctcgctgcggcggcgactgagccaggctgggccgcgtccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctc

SEQ ID NO: 115497 - DNA, 507 bp, Homo sapiens
  Payload ID: 2540
  Gene Symbol: CD276
  Gene Name: CD276 molecule
  ENST ID: ENST00000561416
  CDS Start-End: 353-507
ctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctcctt

SEQ ID NO: 115498 - DNA, 640 bp, Homo sapiens
  Payload ID: 2540
  Gene Symbol: CD276
  Gene Name: CD276 molecule
  ENST ID: ENST00000561176
  CDS Start-End: 1-598
gcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctccta

SEQ ID NO: 115499 - DNA, 2181 bp, Homo sapiens
  Payload ID: 2540
  Gene Symbol: CD276
  Gene Name: CD276 molecule
  ENST ID: ENST00000560928
  CDS Start-End: 78-194
agtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgc

SEQ ID NO: 115500 - DNA, 621 bp, Homo sapiens
  Payload ID: 2540
  Gene Symbol: CD276
  Gene Name: CD276 molecule
  ENST ID: ENST00000560995
  CDS Start-End: 224-621
tttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgc

SEQ ID NO: 115501 - DNA, 1844 bp, Homo sapiens
  Payload ID: 2540
  Gene Symbol: CD276
  Gene Name: CD276 molecule
  ENST ID: ENST00000559073
  CDS Start-End: 1-512
tgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 115502 - DNA, 649 bp, Homo sapiens
  Payload ID: 2540
  Gene Symbol: CD276
  Gene Name: CD276 molecule
  ENST ID: ENST00000558689
  CDS Start-End: 240-649
attcgggccgggcctcgctgcggcggcgactgagccaggctgggccgcgtccctgagtcccagagtcggcgcggcgcgtcttgcagtatcgcccagactggagtacagtggcgcgatttccactcactacaacctccgcctcctgggttcaagcaattctcctgcctcagcctcctgagtagctggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgca

SEQ ID NO: 115503 - DNA, 505 bp, Homo sapiens
  Payload ID: 2540
  Gene Symbol: CD276
  Gene Name: CD276 molecule
  ENST ID: ENST00000563584
  CDS Start-End: 67-505
agtcccagagtcggcgcggcgcggccccacctcttaatactgttacagtggcaattaaatttcaacatgagtcttaaagcacccatgtcatctaggaagaagaaactgtatttgcagcaacactgtgaggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctga

SEQ ID NO: 115504 - DNA, 951 bp, Homo sapiens
  Payload ID: 2540
  Gene Symbol: CD276
  Gene Name: CD276 molecule
  Uniprot ID: Q5ZPR3
  ENST ID: ENST00000564751
  CDS Start-End: 1-951
atgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctga

SEQ ID NO: 115505 - DNA, 550 bp, Homo sapiens
  Payload ID: 2540
  Gene Symbol: CD276
  Gene Name: CD276 molecule
  ENST ID: ENST00000567189
  CDS Start-End: 153-550
ctttctgggctgtggtgccagcatggtgtggaggaagaacccaagactggggttggacagcaggattccagccctgttctgccgccagtcgatgaccagcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgc

SEQ ID NO: 115506 - DNA, 556 bp, Homo sapiens
  Payload ID: 2540
  Gene Symbol: CD276
  Gene Name: CD276 molecule
  ENST ID: ENST00000567582
  CDS Start-End: 83-199
agaccccggaagctgcggaccgggccgggcaggggcagccttccaccacggggagcccagctgtcagccgcctcacaggaagatgctgcgtcggcggggcagccctggcatgggtgtgcatgtgggtgcagccctgggagcactgtggttctgcctcacagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcaggg

SEQ ID NO: 115507 - DNA, 4812 bp, Homo sapiens
  Payload ID: 2541
  Gene Symbol: CD28
  Gene Name: CD28 molecule
  Uniprot ID: P10747
  ENST ID: ENST00000324106
  CDS Start-End: 150-812
atcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaagaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatggcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaaatggagataatggttacaaatgtctcttcctatagtataatctccataagggcatggcccaagtctgtctttgactctgcctatccctgacatttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgtctgctttaaatttgtactttaatattgtcttttggtattaagaaagatatgctttcagaatagatatgcttcgctttggcaaggaatttggatagaacttgctatttaaaagaggtgtggggtaaatccttgtataaatctccagtttagccttttttgaaaaagctagactttcaaatactaatttcacttcaagcagggtacgtttctggtttgtttgcttgacttcagtcacaatttcttatcagaccaatggctgacctctttgagatgtcaggctaggcttacctatgtgttctgtgtcatgtgaatgctgagaagtttgacagagatccaacttcagccttgaccccatcagtccctcgggttaactaactgagccaccggtcctcatggctattttaatgagggtattgatggttaaatgcatgtctgatcccttatcccagccatttgcactgccagctgggaactataccagacctggatactgatcccaaagtgttaaattcaactacatgctggagattagagatggtgccaataaaggacccagaaccaggatcttgattgctatagacttattaataatccaggtcaaagagagtgacacacactctctcaagacctggggtgagggagtctgtgttatctgcaaggccatttgaggctcagaaagtctctctttcctatagatatatgcatactttctgacatataggaatgtatcaggaatactcaaccatcacaggcatgttcctacctcagggcctttacatgtcctgtttactctgtctagaatgtccttctgtagatgacctggcttgcctcgtcacccttcaggtccttgctcaagtgtcatcttctcccctagttaaactaccccacaccctgtctgctttccttgcttatttttctccatagcattttaccatctcttacattagacatttttcttatttatttgtagtttataagcttcatgaggcaagtaactttgctttgtttcttgctgtatctccagtgcccagagcagtgcctggtatataataaatatttattgactgagtgaa

SEQ ID NO: 115508 - DNA, 4526 bp, Homo sapiens
  Payload ID: 2541
  Gene Symbol: CD28
  Gene Name: CD28 molecule
  Uniprot ID: P10747
  ENST ID: ENST00000374481
  CDS Start-End: 223-528
taaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaagaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatggcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaaatggagataatggttacaaatgtctcttcctatagtataatctccataagggcatggcccaagtctgtctttgactctgcctatccctgacatttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgtctgctttaaatttgtactttaatattgtcttttggtattaagaaagatatgctttcagaatagatatgcttcgctttggcaaggaatttggatagaacttgctatttaaaagaggtgtggggtaaatccttgtataaatctccagtttagccttttttgaaaaagctagactttcaaatactaatttcacttcaagcagggtacgtttctggtttgtttgcttgacttcagtcacaatttcttatcagaccaatggctgacctctttgagatgtcaggctaggcttacctatgtgttctgtgtcatgtgaatgctgagaagtttgacagagatccaacttcagccttgaccccatcagtccctcgggttaactaactgagccaccggtcctcatggctattttaatgagggtattgatggttaaatgcatgtctgatcccttatcccagccatttgcactgccagctgggaactataccagacctggatactgatcccaaagtgttaaattcaactacatgctggagattagagatggtgccaataaaggacccagaaccaggatcttgattgctatagacttattaataatccaggtcaaagagagtgacacacactctctcaagacctggggtgagggagtctgtgttatctgcaaggccatttgaggctcagaaagtctctctttcctatagatatatgcatactttctgacatataggaatgtatcaggaatactcaaccatcacaggcatgttcctacctcagggcctttacatgtcctgtttactctgtctagaatgtccttctgtagatgacctggcttgcctcgtcacccttcaggtccttgctcaagtgtcatcttctcccctagttaaactaccccacaccctgtctgctttccttgcttatttttctccatagcattttaccatctcttacattagacatttttcttatttatttgtagtttataagcttcatgaggcaagtaactttgctttgtttcttgctgtatctccagtgcccagagcagtgcctggtatataataaatatttattgactgagtg

SEQ ID NO: 115509 - DNA, 705 bp, Homo sapiens
  Payload ID: 2541
  Gene Symbol: CD28
  Gene Name: CD28 molecule
  Uniprot ID: P10747
  ENST ID: ENST00000458610
  CDS Start-End: 1-705
atgccttgtggtttgagtgccttgatcatgtgccctaaggggatggtggcggtggtggtggccgtggatgacggagactctcaggccttggcaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctga

SEQ ID NO: 115510 - DNA, 5412 bp, Homo sapiens
  Payload ID: 2542
  Gene Symbol: CD2AP
  Gene Name: CD2-associated protein
  Uniprot ID: Q9Y5K6
  ENST ID: ENST00000359314
  CDS Start-End: 457-2376
ctctgtctgggtccccaccttagtctacggtgtcgccttttctaactgcgagtgctaaggaagaggcgaggggcgggctccgaggctaggcgggcgctcggggttggagccgagggtctgggcaaaccggtgggtccctccccactgcgggagcggccagggtgggaaaaccgcggtcgggcgggcggggtagggccctcccgccgccgtggctcctggggaggccaggggtgaggagctgtcgccgcctttgcctctgcctcgagggccgcgctgaagagactggtaggagagcgccgcgggcggatggaggcgactcttcgccccgcctgagctcaggaggggctagcgcggagcgcgggtcccgcctccagccgcgggagcggccgcgcgagccaccactggaggaggaggaggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttactgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgccaacctgaagccatctgaattaaaaaaagatacatgctactctccaaagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggaaagaactggaaaaactgcgaaaagatttggaagaagagaagacaatgagaagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatacttttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaattttttttctacgtgtgagtataaaagacaaaagttgaacagcatggaatctcattgccaaattattagtgaatgtatagttcaggtattctttgagacacacagtatcattaatttctgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgccagtcgtgtcagtctttattggttattttttgttaactttagcatttgtgtatttcagagtatgatgaaaattatattacttcaatttccaaatacaagaataaatagtaaaccaaaaacattaaaaa

SEQ ID NO: 115511 - DNA, 993 bp, Homo sapiens
  Payload ID: 2543
  Gene Symbol: CD300LB
  Gene Name: CD300 molecule-like family member b
  ENST ID: ENST00000314401
  CDS Start-End: 125-571
aaaggcggtctagatgtgcagaaggtgcaagccagagctcaggcagaacttccagagtgcatctgggatctgcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggtgagtcatgtggttctttctcctgcccctacctggggtccctcctaaggggaagccaagcctgggaactcctgcctgtcaccaaatgccagcacctgttctagccagagtcaaggccccaagcccaccctccatctctctcctgcccccatcactgcaatccaccatctccccactctagctctcaccagaaaaccgctctgcagaactcttctcagtgagcatcattctcccagtcaatcagtcaaccttgcattggtggcctaatgggtgccagggggagataagataccaccctctgtggtgcaagacatcaagggacacagaacaggaagggtgatttaccagcctggagctagcattagcaggaacagaggcaggaaacacaacctgtatttggtgacctctggcgcttctgttgagctg

SEQ ID NO: 115512 - DNA, 2286 bp, Homo sapiens
  Payload ID: 2543
  Gene Symbol: CD300LB
  Gene Name: CD300 molecule-like family member b
  Uniprot ID: A8K4G0
  ENST ID: ENST00000392621
  CDS Start-End: 117-722
tctagatgtgcagaaggtgcaagccagagctcaggcagaacttccagagtgcatctgggatctgcatttgccactggttgcagatcaggcggacgaggagccgggaaggcagagccatgtggctgccccctgctctgctccttctcagcctctcaggctgtttctccatccaaggcccagagtctgtgagagccccagagcaggggtccctgacggttcaatgccactataagcaaggatgggagacctacattaagtggtggtgccgaggggtgcgctgggatacatgcaagatcctcattgaaaccagagggtcggagcaaggagagaagagtgaccgtgtgtccatcaaggacaatcagaaagaccgcacgttcactgtgaccatggaggggctcaggcgagatgacgcagatgtttactggtgtgggattgaaagaagaggacctgaccttgggactcaagtgaaagtgatcgttgacccagagggagcggcttccacaacagcaagctcacctaccaacagcaatatggcagtgttcatcggctcccacaagaggaaccactacatgctcctggtatttgtgaaggtgcccatcttgctcatcttggtcactgccatcctctggttgaaggggtctcagagggtccctgaggagccaggggaacagcctatctacatgaacttctccgaacctctgactaaagacatggccacttagagagatggatctgcagagccttcctgccctggccacgtttccagaagagactcgggctgtggaaggaacatctacgagtcctcgggatgcagtgactgagataggggccctgggcctccgccctggccttggagctggtgggcacctccctgttctgcacagctcagggacttagccaggtcctctcctgagccaccatcacctcctggggtgccagcacctgttctcttggtcaggagctgtagagatggagctcaagcactggacgactctgtccccactgctggaataactcgggcacagagcatgggaccaaagtacagaaagaggttgggggagacccccccagccctagacttccatcattccggagaccaactcaacaccgtctttgcctgagaacctgatatatccgtgtttttaaatttttttttttctagcaaagttgggttttaatgacttatgttcataggaaacctctctgatcccacacacaaggagggtgattctgggatgagttcctggttctagggcatgaggggctggatggaccctgtccccagggaggacatggctctgagtccacagggctgaggaggcaatgggaacctccctggcccggcccggtgcttgtcctccccctcccacctcttcctcctcctagctccccaagctccctgcctattcccccacctccgaggggctgcagcttgggagcctcctcagcatgacagcttgggtctcctccccaaaagagcctgtcaggcctcaagaaccacctccaggtggggagggcagtaacgaaaaccatcgcaggaaatggcaccctcccttttcggtgatgttgaaatcatgttactaatgaaaactgtcctagggaagtggttctgtctcctcacaggcttcacccacggcgatgaggcccttgaatgtggtcactttgtgctgtatggttgagggaccctcacaccaaagggaccttcccatgtgagatgtgctcccgcccccacctgcccacaagcaaacacaccacacatgttcggcatgttgccctttgaacacccatgaggacgcctccaacctgctcttggttctaatagggagtactgactgtcagcagtggataaaggagaggggaccctctggtccctagcatggcacccagagcctcccctcttcttgtccttcagccaaagagaaactttctctgactttgaactgaatttaggtctctggccaatgatgggcctgaaaattccataatggccagagaggagagttcgagcccggctaagatcccctgagtcattctgtgagggaccaagacccacagtccaccagccccagggccctacctcctggaatgctttcctggatccagcttcccgaagatccgaccagacccagggaggacggcaccgctccgcgggagggaaagccaaagcatggtgcttcaccagctggactcaggggcgaggggacatgggcgcttgtcaacgtgatgtcattcttttcccaccgtttcttcctgttgatattcaatgaatccgtcaatctctctgga

SEQ ID NO: 115513 - DNA, 1303 bp, Homo sapiens
  Payload ID: 2544
  Gene Symbol: CD300LD
  Gene Name: CD300 molecule-like family member d
  Uniprot ID: Q6UXZ3
  ENST ID: ENST00000375352
  CDS Start-End: 82-666
gttgacttccgagcttggattcaagtccctgaagggcaccagacacctgtgatcaccaaggagaggagaggagacaggaccatgtggctgtccccatctctgctgcttctcatcctcccaggttactccattgccgctaaaatcactggtccaacaacagtgaatggctcggagcagggctcattgactgtgcagtgtgcttatggctcaggctgggagacctacttgaagtggcggtgtcaaggagctgattggaattactgtaacatccttgttaaaacaaatggatcagagcaggaggtaaagaagaatcgagtttccatcagggacaatcagaaaaaccacgtgttcaccgtgaccatggagaatctcaaaagagatgatgctgacagttattggtgtgggactgagagacctggaattgatcttggggtcaaagttcaagtgaccattaacccaggcacacaaactgcagtctcagaatggacaaccacaacagcaagcctggctttcacagctgcagccacccagaagaccagcagccccctcaccaggtccccgctcaagagcacccacttcctgttcctgttcctcctggagctgcctctgctcctgagcatgctggggaccgtcctctgggtaaacagaccacaaagaaggtcttgaaggaggaggagtcagcccgatgatgagagtcccaatgcccattgacgtcctgtccagggcgaaaggccctcccacagaagaaaaaacattttcttttctcttctttttttctttctagagatagagtcttgctctgtcacccaggctggaatgcaatggtgtaatctctgctcactgcaactttcccctcccaggctcaagcgatcctcctgcctcaacctccagagtagctggggctacaggcacatgccaccacccccagctaatttttaaatttttttgtagagatgggcttccaccacgttgcccaggctggtctcgaactcttgacctcaagagatcctcccgcttcgcctcccaaagtggtgggattacaggtgtgagccaccgcacctggcagaaaaacaacatttctatggggaattgactgtggttctagaggcagtgctggccccagcttcagggaacagcctcctagtcccctatctcctgcagccgtgccacctggggctattcccttctctgcacagtccctggggcctgacagagcccttcttccttctgaggtctccaatgcagtagaaaacatgagaagaatgtgtttcccccgagaggcacctatgccgtagtggacatt

SEQ ID NO: 115514 - DNA, 1785 bp, Homo sapiens
  Payload ID: 2545
  Gene Symbol: CD300LF
  Gene Name: CD300 molecule-like family member f
  Uniprot ID: Q8TDQ1
  ENST ID: ENST00000301573
  CDS Start-End: 89-823
agtgagtaccagcagaaggctgggagtctgtagtttgttcctgctgccaggctccactgaggggaacggggacctgtctgaagagaagatgcccctgctgacactctacctgctcctcttctggctctcaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggagtgagggttcccaggctgcaaactacagacctgcagctcatcaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatg

SEQ ID NO: 115515 - DNA, 1764 bp, Homo sapiens
  Payload ID: 2545
  Gene Symbol: CD300LF
  Gene Name: CD300 molecule-like family member f
  Uniprot ID: Q8TDQ1
  ENST ID: ENST00000326165
  CDS Start-End: 113-985
tgaaggaggaagttcaagggcgagagtgagtaccagcagaaggctgggagtctgtagtttgttcctgctgccaggctccactgaggggaacggggacctgtctgaagagaagatgcccctgctgacactctacctgctcctcttctggctctcaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatga

SEQ ID NO: 115516 - DNA, 1554 bp, Homo sapiens
  Payload ID: 2545
  Gene Symbol: CD300LF
  Gene Name: CD300 molecule-like family member f
  Uniprot ID: Q8TDQ1
  ENST ID: ENST00000343125
  CDS Start-End: 1-585
atgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgagccacg

SEQ ID NO: 115517 - DNA, 1689 bp, Homo sapiens
  Payload ID: 2545
  Gene Symbol: CD300LF
  Gene Name: CD300 molecule-like family member f
  Uniprot ID: Q8TDQ1
  ENST ID: ENST00000361254
  CDS Start-End: 1-720
atgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcgtcgactcctgcccccaccacgcctacctccactacgtttacagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatgagccacg

SEQ ID NO: 115518 - DNA, 1275 bp, Homo sapiens
  Payload ID: 2545
  Gene Symbol: CD300LF
  Gene Name: CD300 molecule-like family member f
  ENST ID: ENST00000583937
  CDS Start-End: 76-993
agaaggctgggagtctgtagtttgttcctgctgccaggctccactgaggggaacggggacctgtctgaagagaagatgcccctgctgacactctacctgctcctcttctggctctcaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcgtcgactcctgcccccaccacgcctacctccactacgtttacagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaa

SEQ ID NO: 115519 - DNA, 1825 bp, Homo sapiens
  Payload ID: 2545
  Gene Symbol: CD300LF
  Gene Name: CD300 molecule-like family member f
  Uniprot ID: Q8TDQ1
  ENST ID: ENST00000469092
  CDS Start-End: 278-862
tgaaggaggaagttcaagggcgagagtgagtaccagcagaaggctgggagtctgtagtttgttcctgctgccaggctccactgaggggaacggggacctgtctgaagagaagatgcccctgctgacactctacctgctcctcttctggctctcagcacatggagaccagttgccgttgctgttttgatcaacttcaaaggcattcatccagggtggtttattccagaaccactagaaatcattaggaccaccaggacagcctctccacagccatctgatgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgaccgtctgccccctgctcccctcatcaggaccaacccggggactggtgcctctgcctgatcagccagcattgcccctagctctgggttgggcttggggccaagtctcagggggcttctaggagttggggttttctaaacgtcccctcctctcctacatagttgaggagggggctagggatatgctctggggctttcatgggaatgatgaagatgataatgagaaaaatgttatcattattatcatgaagtaccattatcgtaatacaatgaacctttatttattgcctaccacatgttatgggctgaataatggcccccaaagatatctgtgtcctaatcctcagaacctgtgactgttaccttctgtggcagaaagggacagtgcagatgtatgtaagttaaggactttgagatagagaggttattcttgctgattcaggtgggcccaaaatatcaccacaagggtcctcataagaaagaggccagaaggtcaaagaggtagagacaaagtgatgatggaagtggacgtgggtgtgacgtgagcaggggccatgaatgccgcagccttcagatgccagaaagggaaaggaatggattcccctgcctggagcctccaaaagaaaccagccctgcccacgccttgacttgagcccattgaaactgatcttgagctcctggcctccagaattgcaggagaataaatttgtgttgtttttaatga

SEQ ID NO: 115520 - DNA, 860 bp, Homo sapiens
  Payload ID: 2545
  Gene Symbol: CD300LF
  Gene Name: CD300 molecule-like family member f
  Uniprot ID: Q8TDQ1
  ENST ID: ENST00000462044
  CDS Start-End: 56-553
ccagaaccactagaaatcattaggaccaccaggacagcctctccacagccatctgatgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgac

SEQ ID NO: 115521 - DNA, 996 bp, Homo sapiens
  Payload ID: 2545
  Gene Symbol: CD300LF
  Gene Name: CD300 molecule-like family member f
  Uniprot ID: Q8TDQ1
  ENST ID: ENST00000464910
  CDS Start-End: 56-937
ccagaaccactagaaatcattaggaccaccaggacagcctctccacagccatctgatgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacggaatacagcaccatcagcaggccttagcctgcactccaggctccttcttggaccccaggctgtgagcacactcctgcctcatcgac

SEQ ID NO: 115522 - DNA, 720 bp, Homo sapiens
  Payload ID: 2545
  Gene Symbol: CD300LF
  Gene Name: CD300 molecule-like family member f
  Uniprot ID: Q8TDQ1
  ENST ID: ENST00000581500
  CDS Start-End: 1-720
atgtggctgcctcagctcgacctcatgagggtcatcagtgctaagagtcaaggctactccattgtcactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcgtcgactcctgcccccaccacgcctacctccactacgtttacagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaaggtactgcagcccctggagggcgacctctgctatgcagacctgaccctgcagctggccggaacctccccgcaaaaggctaccacgaagctttcctctgcccaggttga

SEQ ID NO: 115523 - DNA, 988 bp, Homo sapiens
  Payload ID: 2546
  Gene Symbol: CD300LG
  Gene Name: CD300 molecule-like family member g
  Uniprot ID: Q6UXG3
  ENST ID: ENST00000293396
  CDS Start-End: 62-763
gtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgaatcacagaacatcagagctggatccagatgaagcctttgagatctctagcctgacttttctctcagtttgaagcaaatcgcctttcagaacgcccaggggtcagggagctgttagagatgcactctccagggccccagacccagctgaaccctccaggggtggggtccagggactctggcagtgctacaaactctagtgtgcttttacaaaagatgagactgaggcccagagagggtaaaggtcttgcccatggtcacacagcaggtggtggcccaaacagagaacaggacccaga

SEQ ID NO: 115524 - DNA, 2758 bp, Homo sapiens
  Payload ID: 2546
  Gene Symbol: CD300LG
  Gene Name: CD300 molecule-like family member g
  Uniprot ID: Q6UXG3
  ENST ID: ENST00000317310
  CDS Start-End: 42-1040
acagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgactgcggaggaaaaggaagccccttcccaggcccctgagggggacgtgatctcgatgcctcccctccacacatctgaggaggagctgggcttctcgaagtttgtctcagcgtagggcaggaggccctcctggccaggccagcagtgaagcagtatggctggctggatcagcaccgattcccgaaagctttccacctcagcctcagagtccagctgcccggactccagggctctccccaccctccccaggctctcctcttgcatgttccagcctgacctagaagcgtttgtcagccctggagcccagagcggtggccttgctcttccggctggagactgggacatccctgataggttcacatccctgggcagagtaccaggctgctgaccctcagcagggccagacaaggctcagtggatctggtctgagtttcaatctgccaggaactcctgggcctcatgcccagtgtcggaccctgccttcctcccactccagaccccaccttgtcttccctccctggcgtcctcagacttagtcccacggtctcctgcatcagctggtgatgaagaggagcatgctggggtgagactgggattctggcttctctttgaaccacctgcatcccagcccttcaggaagcctgtgaaaaacgtgattcctgggccccaccaagacccaccaaaaccatctctggggcttggtgcaggactctgaatttctaacaatgcccagtgactgtcgcacttgagtttgagggccagtgggcctgatgaacgctcagacccctccagcttagagtctgcatttgggctgtgacgtctcccacctgccccaataagatctgctctgtctgcgacaccaagatccagctggggactcccctgaggcctgcctaagtccaggccttggtcaggtcaggtgcacattgcagggataagcccaggaccggcagagagtggttgcctttccatttgccctccctggccatgccttcttgcctttggaaaaatgatgaagaaaaccttggctccttccttgtctggaaagggttacttgcctatgggttctggtggctagagagaaaagtagaaaaccagagtgcacgtaggtgtctaacacagaggagagtaggaacagggcggatacctgaaggtgactccgagtccagccccctggagaaggggtcgggggtgggggtaaagtagcacaactactattttttttctttttccattattattgttttttaagacagaatctcgtgctgctgcccaggctggagtgcagtggcacgatctgcaaactccgcctcctgggttcaagtgattcttctgcctcagcctcccgagtagctgggattacaggcacgcaccaccacacctggctaatttttgtacttttagtagagatggggtttcaccatgttggccaggctggtcttgaactcctgacctcaaatgagcctcctgcttcagtctcccaaattgccgggattacaggcatgagccactgtgtctggccctatttcctttaaaaagtgaaattaagagttgttcagtatgcaaaacttggaaagatggaggagaaaaagaaaaggaagaaaaaaatgtcacccatagtctcaccagagactatcattatttcgttttgttgtacttccttccactcttttcttcttcacataatttgccggtgttctttttacagagcaattatcttgtatatacaactttgtatcctgccttttccaccttatcgttccatcactttattccagcacttctctgtgttttacagacctttttataaataaaatgttcatcagctgcata

SEQ ID NO: 115525 - DNA, 1060 bp, Homo sapiens
  Payload ID: 2546
  Gene Symbol: CD300LG
  Gene Name: CD300 molecule-like family member g
  Uniprot ID: Q6UXG3
  ENST ID: ENST00000377203
  CDS Start-End: 70-891
aaagacccgtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccagcttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgaactccctgatgttttctctgagcctgccttggctctgagaccaaggtggtgtggctgctctgggacccaggctgagggtggtgctctggggaccaggggcaagagaataagggtccctgtgcccattgtctggagctgggaacctgccccaaggctactgctgcaagaagagactgtgccctccgaggccagcactccaacggaggg

SEQ ID NO: 115526 - DNA, 1399 bp, Homo sapiens
  Payload ID: 2546
  Gene Symbol: CD300LG
  Gene Name: CD300 molecule-like family member g
  Uniprot ID: Q6UXG3
  ENST ID: ENST00000539718
  CDS Start-End: 70-993
aaagacccgtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggaccctgctgtcctccctccccttctcccaccttccagcctctggctacaacacgcctgcagcccaaggcaaaagctcagcaaacccagcccccaggattgacttctcctgggctctacccggcagccaccacagccaagcaggggaagacaggggctgaggcccctccattgccagggacttcccagtacgggcacgaaaggacttctcagtacacaggaacctctcctcacccagcgacctctcctcctgcagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgaactccctgatgttttctctgagcctgccttggctctgagaccaaggtggtgtggctgctctgggacccaggctgagggtggtgctctggggaccaggggcaagagaataagggtccctgtgcccattgtctggagctgggaacctgccccaaggctactgctgcaagaagagactgtgccctccgaggccagcactccaacggagggggctgcagcatcgcacttcaggcaacagaagcccctcctggcccctcctccctctgctgtttactgagatgcctccactccattcctttaaacacaagggcaggaaagcggagctaccattgccttctttcctggcgccagtgaggacaaaagactcaggcctggtcaccccaaggagggtctggggtggaaatgggactttgggctgtggcttaggaagcagctgttgttgtctca

SEQ ID NO: 115527 - DNA, 1459 bp, Homo sapiens
  Payload ID: 2546
  Gene Symbol: CD300LG
  Gene Name: CD300 molecule-like family member g
  ENST ID: ENST00000588884
  CDS Start-End: 65-517
cccgtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccaggtaacagatatctctccttccccaggctggggacaggagctgcagagggaagagggaggggtggtggggcataatcctggtaccaacattatgggcactgagtcctcagggagatcatgcaggtcaagcaccgagcaaggcttggggcacagaaggagccgcctgagtcttggccattgtctcactcttgctgcccgaggtcacaccagtagtagatgtcagagcaggaccggacccagatctgtccagggctgggctcggcgcctttcctttctgcccaggtgtgctggagggagatttccataggctgggtacaagatagacatatcaggggataaagaagactcctcgcctggtgtcagagatattcctgaggcctcccgaggctgggccaaccattgctgcattccagacccagcccacagcatcaccctggacatgctggcctcgccctgcttgtgccctcaactctcccctcctggcctccacctccccagatattgaagtccagccacaggtgctagagtgcctgggaaccagcctctgggtaggatgcctgaaggagggatcgttaaatgcagggacactagggggccggggctggagctatggggcctgggtaggggataaagcacctctctgggagcccagaaccccaagtggacctgctgagctaaggagaaagaagccagagagggcccaggggagtgggagccttggtctgctggccagtgtgggcgaggtacatctttgtatccccatttcacggatgagggactgaggctccaagagactaagtgatttgcccaagatctcacagcaggaagtgatggaactgggattcaaacacaagtcgtttccagctttgatgtctgctttattcctctcctagccccatagctgggacctatcccaatcccaggcccatccctaccaccatagcccctattttttttttattcctttatccatggatctttaatttgaggaaataaagttaaacttgccaaatagca

SEQ ID NO: 115528 - DNA, 942 bp, Homo sapiens
  Payload ID: 2546
  Gene Symbol: CD300LG
  Gene Name: CD300 molecule-like family member g
  Uniprot ID: Q6UXG3
  ENST ID: ENST00000586233
  CDS Start-End: 62-730
gtgtgactgaagaggagctcacagttcccagcgtctgctcccacggtgtccagcgcccagaatgcggcttctggtcctgctatggggttgcctgctgctcccaggttatgaagccctggagggcccagaggaaatcagcgggttcgaaggggacactgtgtccctgcagtgcacctacagggaagagctgagggaccaccggaagtactggtgcaggaagggtgggatcctcttctctcgctgctctggcaccatctatgcagaagaagaaggccaggagacaatgaagggcagggtgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgaactccctgatgttttctctgagcctgccttggctctgagaccaaggtggtgtggctgctctgggacccaggctgagggtggtgctctggggaccaggggcaagagaataagggtccctgtgcccattgtctggagctgggaacctgccccaaggctactgctgcaagaagagactgtgccctccgaggccagcactccaacggagggggctgcagcatcgcacttcaggcaacagaagcccctcctggcc

SEQ ID NO: 115529 - DNA, 631 bp, Homo sapiens
  Payload ID: 2547
  Gene Symbol: CD300A
  Gene Name: CD300a molecule
  Uniprot ID: Q9UGN4
  ENST ID: ENST00000310828
  CDS Start-End: 30-590
caagtgccgcctgtgctggggaagggaccatgtggctgccttgggctctgttgcttctctgggtcccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggcccca

SEQ ID NO: 115530 - DNA, 1858 bp, Homo sapiens
  Payload ID: 2547
  Gene Symbol: CD300A
  Gene Name: CD300a molecule
  Uniprot ID: Q9UGN4
  ENST ID: ENST00000360141
  CDS Start-End: 289-1188
gctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaaacaatg

SEQ ID NO: 115531 - DNA, 382 bp, Homo sapiens
  Payload ID: 2547
  Gene Symbol: CD300A
  Gene Name: CD300a molecule
  Uniprot ID: Q9UGN4
  ENST ID: ENST00000361933
  CDS Start-End: 30-341
caagtgccgcctgtgctggggaagggaccatgtggctgccttgggctctgttgcttctctgggtcccagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggcccca

SEQ ID NO: 115532 - DNA, 1163 bp, Homo sapiens
  Payload ID: 2547
  Gene Symbol: CD300A
  Gene Name: CD300a molecule
  Uniprot ID: Q9UGN4
  ENST ID: ENST00000392625
  CDS Start-End: 47-499
agggcctggagctgctgcaagtgccgcctgtgctggggaagggaccatgtggctgccttgggctctgttgcttctctgggtcccagcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcacctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttattgagggagaagtaaaaacttatttaa

SEQ ID NO: 115533 - DNA, 1459 bp, Homo sapiens
  Payload ID: 2547
  Gene Symbol: CD300A
  Gene Name: CD300a molecule
  ENST ID: ENST00000577511
  CDS Start-End: 780-1289
gcggtgcgctctgtctaccacataagatggacagatgaaggtccacacccctgggagaggaaggagccagggcctctcccggctctgcacccacgtaccttggctgaaccacagcggggcaagtgataagggttcgtgaaagatgacctggttctttctgtgttgtgtgtgggtgtgtgtgttcctcttctgacctcttgagttggacaattcagtcatttacctgagagttaatgggtcaagattctgtgatcttcaaggaaaacgttaagacgacagaggaatatcctggtagaggaccctggccccaaggtggtccccagtctcctgtttatgattagaggggtttggggtggtgattcaggttggaagagagaaagcgcagaaacacaagcctgggagcactggggatccatgtgatcgttccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccatggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggctt

SEQ ID NO: 115534 - DNA, 1517 bp, Homo sapiens
  Payload ID: 2548
  Gene Symbol: CD300C
  Gene Name: CD300c molecule
  Uniprot ID: Q08708
  ENST ID: ENST00000330793
  CDS Start-End: 362-1036
gaaatggcccagcttggctctgccttctgcagtgtgagtaacacactgaagccagaagctgtgggctgtggggaagtggctgcatcgccacccaagggaccctggactttgccagacgtcagggttgagaggagccactagcaccatcccagagctgtcagcaccggcctcagcccaggcggctctctccctgagcttcctgtaccctgaccctctccagcctcagacctgagacagggctggacaaggaagcagagagcagaagaaaagcagaagcgaagctcagatctgctgggaggagattacattttgtcccctcctggggtcttgcacagtggcaggtgacattcgtgttacaggaatgactgccagggcctgggcctcgtggcggtcttcagctctgctcctcctgcttgtcccaggctattttcctctgagccaccccatgaccgtggcgggccccgtggggggatccctgagtgtgcagtgtcgctatgagaaggaacacaggaccctcaacaaattctggtgcagaccaccacagattctccgatgtgacaagattgtggagaccaaagggtcagcagggaaaaggaatggccgagtgtccatcagggacagtcctgcaaacctcagcttcacagtgaccctggagaatctcacagaggaggacgcaggcacctactggtgtggggtggatacaccgtggctccgagactttcatgatcccattgtcgaggttgaggtgtccgtgttcccggccgggacgaccacagcctccagcccccagagctccatgggcacctcaggtcctcccacgaagctgcccgtgcacacctggcccagcgtgaccagaaaggacagccccgaacccagcccacaccctggctccctgttcagcaatgtccgcttcctgctcctggtcctcttggagctgcccctgctcctgagcatgctgggtgccgtcctctgggtgaacagacctcagagaagctctagaagcaggcagaattggcccaagggtgagaaccagtagcatctgctgtccatcaaggccctgtgctgcaacagagcccctctgggggactggaatgacctcctgaccactccctcccgggctgctctctccacatctcctggaatcctttgtgagcctccttcagccttttccctgtgcccgatcctcatgtgtcacatgtgaacctgacggacatggacgccctgagctgtgagtccacgtctcatgtgcacgccccggccagctaagcctcgggccgtcagcaatacctctgagtgcccggatgccctccctgcacccttccatttctccaggagcctggcactgcttcctccaccgttttcacagggagaagcaggtctaggactcccctgcacctttgccaccataatggcccacactccctgggtccaggagtgtagaatatgcggctgcttccatttgctgagtgtgtcgattcaatgatgctttcaaactttaataaatgacaatgtgtagg

SEQ ID NO: 115535 - DNA, 3501 bp, Homo sapiens
  Payload ID: 2549
  Gene Symbol: CD300E
  Gene Name: CD300e molecule
  Uniprot ID: Q496F6
  ENST ID: ENST00000392619
  CDS Start-End: 118-735
gagaacacaaaggaaacttggacaagtagaaagtggatgacccaggctccgttacatatacttggattccagctgggacctagatttgctgaggacggaagccaaggagacaggaacatgtggctgctcccagctctactccttctctgcctctcaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctcggacctggttagggtgtatgtttccccagcaattacaaccccaaggaggaccacacatccagccacacctcccatcttcctggtggtgaaccctgggcgaaacctcagcaccggggaggtgttgacccaaaattcagggttccggctcagcagccctcacttcctgctcgtggtccttctgaagctgcccctgctcctgagcatgctgggtgctgtcttctgggtgaacaggcctcagtgggctcctcctggaagatagagccaggctgacccgaagccctgcagagccccatccccaggagtgccccgtgcagggagtcaacctttcagactggatgcgagagacctgtggactctggagggatttattgttcctgtgcctcaaaggagggtcctggctcttagaggacactcctctggagtcctcaatgtgcagcttgggggtcctcctttctcctccccagtcccctgcctccctgccctcatgcccacttcccaagggcaagaattccctggaagttggccgggcaccatagcgagtgcctataatcccagctcaggaggctgaggcaggaggatcggctgaacgtaagagttccaggccagcctgggcaacatagagagccctgtctcagagagagagagagagagagagagagagagacagagagagagagagagagagagcgagagagagagagagagagagaaaaggacggaggaagggagggaaaaaattttctggaggagcctggcccttcattcttcttggcacaaatgcttctcaggccagtttcccccagggcaataactacctccttcctgcagacaggagtctccctgaggacacacccctcacagccccagcctttaggctcacagagctccatctcttctctgggacaaccccaagggagcttggtcccggcagagcttgctcatgcagttgcccagtgtcccacatgctcagggctcctctcgtcttctgacgccccttgggtctccctggctttaaggccccttctctccctgtaaccaggcagtgtgtggctgggctcagaacatctctgcctgggtgggccgtggatgagctgctccaggttaaagttctggggcgagttgaaacagtaaagggagaaggagctggtgggtgcccctgatatcactcctggaattcccccacctggaggtgtccaatgcacaaggtcaacagagtcagttctgtccactttagaagtctggctgagaccacctgttagcaattaaccttttccacaggcagagcagatatcgtttttcaaagacaggatggagggcacagaggtgaaggatacttgtccacacttgaagtgcacagtgctatcaccactactggtgacccctggctcgggaatgagctcagttggttttctgaatgtttgtcaattactctgtttccctaaagtttgtggggaggactcccacagtctgccacaagcaagcatcaccatctccacttgctacctacatctggaccagtgctccccctctgcccccaggcctgagctcatcctgagctagtgatgccagtgtccagagcacatggagtgaccctctgagtgccgagtgcttaggcagagctgccgtgctctgaacttgagctctggtggggctcccagctccatcatgcatggtgactaggggaaagatggggctggcccaggactcatgctgaaagagaaattcaatctaacaaggcccatattaattatattaacccgggaaatatgatgatgagcaagaaaggagcttatgattcattttatgagaaggataagctcccaagtcattacagcataggaagaactctagagccacaagagatgcttcctgatgtcagggggttggtgaggagaatatcatgccaagctggccaggtcagggaaagaaggtgacattcatgttgatgttgaaggaggtataggatttcagcggagcagggatggagcaacagggagagagagaggacagagaaacagcataagtgaaagcagagaggcgggaaataatcttcataacaatagtcacttatagaagacctatcagcaaatggactgtactgttcacatacagatgctcatggtaggatgtgtctaagattccaatggagtgaaattttcctgtggcaggccagatggaactaatctagaagaactcaggtggtggcaggttcaggaggcttaggactcaactcttacttaaactttgattagctatggtgggatggatttgagcagaacaagatgggattgcagatgtgctttaggaggacttgcctagcagatgtagcaaagtctgaaaggaagaatctgggagtccggagtcttaagcctggaaaaccagaggaatcgggcatcattgacagaagtaggaaagtcaagagcaggcttggatgatgcagagcttagttttctgtgtgtttggaatcatcaggcagagaggtctagcagatagctagagatgtgggttagcagagtgttgagggctggagaggaatgtgtgtagagagattaactggaacccagcaagaagtgaaaacatggagggaagagttcagaaccaaggacagagccctcggggcacctgcatttaaagacaaagggtaggaggaagacattgatcaaggtgctggagcagaatcaaacaggtggaagatgagaagtcaagagccatgaatgtttcaaggaggagagcagagctagagaggtggaggaggaccgggattgagaggaggctattgaacttatcattcacaaggtcactaatgaagttcagaagagcagatcaacagagcaatgacagcagaagccagaagagaagagttaagaaagagtagacagatggcagacagcaggtgcaggagaaacaaacagtggcttctccatgctttgaattttcccttctcccttactccctttttttcccctattcttcctttcttttttccctttatttactcattcattcaataaacttttattgtgtg

SEQ ID NO: 115536 - DNA, 570 bp, Homo sapiens
  Payload ID: 2549
  Gene Symbol: CD300E
  Gene Name: CD300e molecule
  ENST ID: ENST00000412268
  CDS Start-End: 206-570
ctctgaagggactggctctgatcctagcagaagaagaacaaccccaagctctccagcaaggatccctttaggaagcagcacaagcaggccccggctccatcaccagactcttggctgtgacaagccctttgtaccctgccaagctcccactgtgggaaatgcagtcctgagctctgtccagaacctagaaggaggtgctgctgggatgtgccacctccaggaggaagctgggggcaggtggaagggaggaggctgtttgtctctgaagggccccggctctgtgactggcactgcgggggactctctgacagtgtggtgtcagtatgagagcatgtacaagggatataacaagtactggtgccgaggacagtacgacacgtcatgtgagagcattgtggagaccaagggagaagagaaggtggagaggaatggccgcgtgtccatcagagaccacccggaggctctcgccttcactgtgaccatgcagaacctcaatgaagatgatgctggatcttactggtgcaaaattcagacagtgtgggtcctggattcatggtcacgcgatccctc

SEQ ID NO: 115537 - DNA, 3741 bp, Homo sapiens
  Payload ID: 2550
  Gene Symbol: CD302
  Gene Name: CD302 molecule
  Uniprot ID: Q8IX05
  ENST ID: ENST00000259053
  CDS Start-End: 45-743
ctctccggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttgtgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatgatggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcag

SEQ ID NO: 115538 - DNA, 3803 bp, Homo sapiens
  Payload ID: 2550
  Gene Symbol: CD302
  Gene Name: CD302 molecule
  Uniprot ID: Q8IX05
  ENST ID: ENST00000429078
  CDS Start-End: 58-582
ccccgccccgctcctctccggccgcgcagccgctgccgcccacccgcacccgccgtcatgctccgggccgcgctgcccgcgctcctgctgccgttgctgggcctcgccgctgctgccgtcgcggactgtccttcatctacttggattcagttccaagacagttgttacatttttctccaagaagccatcaaagtagaaagcatagaggatgtcagaaatcagtgtactgaccatggagcggacatgataagcatacataatgaagaagaaaatgcttttatactggatactttgaaaaagcaatggaaaggcccagatgatatcctactaggcatgttttatgacacagatgtcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttgtgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatgatggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaagacaactgtcatactgaattttattaaaagtatatatacttcaaattcaaagcatcccttaggacccacagaatatattaaaactaccacccttaaattttatatttttgctttaagacagacaatgcaaaggtaactggcaagaggtgagcaaatgttttagaacatttatattattgcttaaaatgagatttgaaattgtaataaaattcttggttatg

SEQ ID NO: 115539 - DNA, 3866 bp, Homo sapiens
  Payload ID: 2550
  Gene Symbol: CD302
  Gene Name: CD302 molecule
  ENST ID: ENST00000553424
  CDS Start-End: 58-645
ccccgccccgctcctctccggccgcgcagccgctgccgcccacccgcacccgccgtcatgctccgggccgcgctgcccgcgctcctgctgccgttgctgggcctcgccgctgctgccgtcgcgggagcggacatgataagcatacataatgaagaagaaaatgcttttatactggatactttgaaaaagcaatggaaaggcccagatgatatcctactaggcatgttttatgacacagatgatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctatcccatacaaaaggaaatatttatcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaagtttttggtaatcttgcactaagacatcaacaaaatgccctggcagagataacttgggaaagattttaatataaaacttgacattggatattagagctttaatggtattccttattccagtaacatttttatgtactcatctgctgtgaaaagtctttaggttcattaaaaaaacaggttttagaaatgatcttagatctaatatagtgattttaagcatcccgtcaaaggcagaatctgtcacttgaatgaaggaaagcttaaagcccaagcagataaaaataaaagcccagcctatttgtcttgcctgctgtatcttccctatttagttgacccactttagtttatatgtttattagtaaacatgaaatggggaataagtgattttaagtacatcccatacatttaaatatctttgataattgttatttttttggcagataattcctctagaatgtgtatctttttatgatttagatgaagaaaattttacaacttttaacaccccacaccaattttagtttcattacttttacacacaccattttatcacaaatgactcaagttttaatgaatgtttataaattatttgaaacaaaatatgatcgctgtgtccaggatggcatagagaaagctggcaattaggttaacacttacatattatagtgcccctttaaggatttctctcttgccaccataccttttgtactttcccctatacaagatgtatctcattctcctcaagcatttataaatttttccttcaatgacatgaaaactgtgcaagcaaaaaccgaagaaaaacacttaagtacaactgtagtgacagtgatcaaagttttcagtgcatttattgtacattttaagaaaaaggtgaaaatcatttggggagtaaaaaaatgaaaaagctgaaacgagtaattttcctcaccatcaataaaccaaaaacaggaaagataaagaatgtataaatttcacgtaaattagtcacgtatcacttatcaatggggatacgttctaagaaatgcatagttagggaatcttgtgtgaaaatcagcttgtatttacacaaacccagatggtagagcctattttgtcccaaacctacacagcatgttactgtgctgaatactgcagacaattgtaacacaatatttgtgtatctaaatatagaaaaggtacagtaaaaatatggtctactaaggaaacactgttctatatgtggtccattactgactgaagtatactgtctagaagtctgaggctcaaagaaaagtaatccctcttctgaatccacaccccatcaattatcttactttcttctggggagatagatagatatactatctcactagcttgactaatggcaacaaagttccagcttgtgtagtctctttttattgaccacatgaatcgaaaacactcatcacaattaatggcactatcattaatgagacatgagtaactaaaaagtgatagaaaactattaacagtgcggctacatggtactgaaaatgcaggcattacaccagctgttacacaagcacaagcatgctctgtaagagctttacatttctgagattttgtatagtgattgagatgtctattttattattgatagactattactaatgtcaatattgaacactaccctggaattcctgcctggttttcctacccaaattgtaccactccttgaagaactacaggcacagtaaaaaaaatatggcgtattatgtgaactaaaagagttctaaaggagttcttaaaggagtggtagaatttgggtaggaaagtgattaagtccaacttaaaaccaacagtctcaaacgtctacaactacaatgtccaatgagccactagccacatgaggctatttaagtaaatttagtttaaaatccagttttcgaattacattagccacattgtcaagtgttcaaatcacaggtggttagtggctactgtactgggcaacatacattatagaacattttcattataggaagttttattgggcagtgctgctcttaaatcctaccttccactcaactcccatacaactttcttttgtacattttgatactttctacctaatggcagctcttccaaaatagctgctttaaactctgatttaattttcaatatttggtttcatttttcaacaggccaagaggcctctggtaatgaagtgctatatatatatatatgatggagtctcactgtgctgcccaggctacagtgcagtggctcgatcttggctctctccaatctccgccttgcaggttttcaagcaattctcctgcctcagcctccttagtagctgggaccacagacatctgtcaccacacccagctaactttttgtatttttggtagagacggggtttcgccatattgactgggctggtctcaaactcctgacctcaagtgatccacccaccttggtctcccaaagtgctgggattacatgcgtgagccaccacacttggcctacattttttctttatataccagaacatctataacaggcaccttatctactcattagtgaagagataattggattacacaggcaggcttgtttactacatccagaatgtagaaactgctttcttcaacatcttggttctagctagtaataacaatataattctttggcagatattcagaataacattttaaactacattttcttagaaaattgcattcttgtagtgagcagtgtatggtctcttttgttcagaatttaaaactgataaccaatgaaagccttttctcttattcctctaccgtcatttacatgataatctgaagctaatatgacaatatttaaatactaagtggtactagggaactacaagaatactgtaaagcttaagccattgttatcactgtcatttagcatttaataacaaaactatacagaattatgtgcataccaatgaatgttttgtaccatctagttaaattttttaaataaagttttatgggttaagcagaagacaactgtcatactgaattttattaaaagtatatatacttcaaattcaaagcatcccttaggacccacagaatatattaaaactaccacccttaaattttatatttttgctttaagacagacaatgcaaaggtaactggcaagaggtgagcaaatgttttagaacatttatattattgcttaaaatgagatttgaaattgtaataaaattcttggttatg

SEQ ID NO: 115540 - DNA, 1250 bp, Homo sapiens
  Payload ID: 2551
  Gene Symbol: CD320
  Gene Name: CD320 molecule
  Uniprot ID: Q9NPF0
  ENST ID: ENST00000301458
  CDS Start-End: 66-914
tgcgcgtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctc

SEQ ID NO: 115541 - DNA, 1119 bp, Homo sapiens
  Payload ID: 2551
  Gene Symbol: CD320
  Gene Name: CD320 molecule
  Uniprot ID: Q9NPF0
  ENST ID: ENST00000537716
  CDS Start-End: 61-783
gtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcagggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctc

SEQ ID NO: 115542 - DNA, 861 bp, Homo sapiens
  Payload ID: 2551
  Gene Symbol: CD320
  Gene Name: CD320 molecule
  ENST ID: ENST00000599573
  CDS Start-End: 1-266
cgcaggttggagcgtggcgaacaggggctctgggcctggcgctgctgctgctgctcggcctcggactaggcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgca

SEQ ID NO: 115543 - DNA, 1729 bp, Homo sapiens
  Payload ID: 2551
  Gene Symbol: CD320
  Gene Name: CD320 molecule
  ENST ID: ENST00000596002
  CDS Start-End: 11-256
tggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcagatcatctcgctatgaggagcctggtgaagactctgggatcagcgagacctgagttcgaagcccaactccgctaccagctcttttttttttcttttttgtggtgacggagtctcgttctgtcgcccaggctggagtgcagcagtatgatttcggttcattgcaacctccatctcccaggtttaagcgattctcatgcttcagcctcccgagtagctggcattacaggcgtgcactaccacgcccggctaatttttgtatttttaacagagacggggtttccatgtaggccaggctggtctcgaactcgtgacctcaagtgatccacctgcctcggcctgccaaagtgctgagattacaggcgtgagccactgcacccagcctctgccaccagctgtatggcctcctcttggttcctttctctgtaacctggggagtgcagtagcacctgcccagtggggctcttgagcccaggaactgctacactctgaaccccactcgtactaggggctcagtaacaagcagccgccagtgtggttcctatatcccgggacttcgcctgtctcctgcggatcacagccagtgactactgtgctcttggagaaaggtccagcctccagcttcccaggcttcatttgcatccatctcgcaggccccagctcaggctcgtgcccacccaccaagttccagtgccgcaccagtggcttatgcgtgcccctcacctggcgctgcgacagggacttggactgcagcgatggcagcgatgaggaggagtgcaccgcctggcctgcctagcaggcgagctccgttgcacgctgagcgatgactgcattccactcacgtggcgctgcgacggccacccagactgtcccgactccagcgacgagctcggctgtggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctgcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctc

SEQ ID NO: 115544 - DNA, 1444 bp, Homo sapiens
  Payload ID: 2552
  Gene Symbol: CD33
  Gene Name: CD33 molecule
  Uniprot ID: P20138
  ENST ID: ENST00000262262
  CDS Start-End: 22-1116
ctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacacca

SEQ ID NO: 115545 - DNA, 1089 bp, Homo sapiens
  Payload ID: 2552
  Gene Symbol: CD33
  Gene Name: CD33 molecule
  Uniprot ID: P20138
  ENST ID: ENST00000391796
  CDS Start-End: 22-954
ctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccggtacgttgaggccaacagatcaggagatgatggccattgaaaagatagtttcttggccgggcacagtgtttcacacctgcaatcccagcacctttggaggccaaggcgggcggatcacgaggtcaggagattgagactatcctg

SEQ ID NO: 115546 - DNA, 1494 bp, Homo sapiens
  Payload ID: 2552
  Gene Symbol: CD33
  Gene Name: CD33 molecule
  ENST ID: ENST00000436584
  CDS Start-End: 56-694
actcccttcctcttttctgctcacacaggaagccctggaagctgcttcctcagacatgccgctgctgctactgctgcccctgctgtgggcagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccggtgagtgatggggcatcctggcatccagtctgtcctgcagacacctcctcccaatgtggcccaccgtcatgccccattcagcatttccagaactgagcttattgtctttcctcctgtttaacagtgtaggttttaatatttttcaggtacgttgaggccaacagatcaggagatgatggccattgaaaagatagtttcttggccgggcacagtgtttcacacctgcaatcccagcacctttggaggccaaggcgggcggatcacgaggtcaggagattgagactatcctggctaacatggtgaaaccccgtctctactaaaaatacaaaaaattagccagatgtggtggctggcgcctgtagtcccagctacttgggaggctgaggcaggagaatggtatgaacccgggaggcagagcttgtagtgagccgacatagcaccactgcactccagcctgggtgacagagagagactctgtcccaaaaagaaaaaaaaaatagtttcttattcaccgttcccgagagggcacaccacaccatgcaaggccatatggagaagcaccagggtcagtcaggaagcagagggagcaaggagaaaatgggacaagagccttcactgtggctttcatggaaaagaatgggcaagacagggtaagcaagctaggcaggtttaggattggctacttagaacaatttcagcagactctggggtataggagttgtctctagttgtctggtacatggccctgggtttattaaggaggattgtggtctggagtgtaagagctcaataaaggatccagctggtagtgtgggctttagattgactggtttgcacatgaaaggtgcacttgtatgcaagtcctttattagctctagaaatctactatccttggg

SEQ ID NO: 115547 - DNA, 1023 bp, Homo sapiens
  Payload ID: 2552
  Gene Symbol: CD33
  Gene Name: CD33 molecule
  Uniprot ID: P20138
  ENST ID: ENST00000421133
  CDS Start-End: 56-769
actcccttcctcttttctgctcacacaggaagccctggaagctgcttcctcagacatgccgctgctgctactgctgcccctgctgtgggcagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctg

SEQ ID NO: 115548 - DNA, 8246 bp, Homo sapiens
  Payload ID: 2553
  Gene Symbol: CD34
  Gene Name: CD34 molecule
  Uniprot ID: P28906
  ENST ID: ENST00000310833
  CDS Start-End: 323-1480
aagaagtgggatggggcctctccagaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacacatctgttatgtgactctgtcttagctgggtgtgtctgcatgcaagagtgacaccctccattagacctagctagactgtgcagtgatgtggtggggaggaccagccagggaagagggagcacctcagcagacacaggcaccagccaggatgctaaggacctttagccaagtctgccaactattctcctccatggggagaggaaacatccatttccagtggtagaaaggcagacccgaatgtaccagggagcttccaaatggagggtggtatgttgggttcttaggagctgtacccttcatgaacacccttctgagaagaggagcatgctgatcactgctgcaaaatatgcaaaacaaagggaaggggcaatgtcctgtgcaccctttattatcaggccacccccctccccagccccccaggtcagagtagacacagtgaaggactatgtggggactgttgttctagagacctggcagccaactcagggagggggctggtttccaccctcaagattaagacagcagcctaattaaaaaaaaaatctgtaagcatgtacctccccccagcttccaaaacaacccccaccccacccctaccaggccataggaagttggggagggagtgctgaggagctccaggaaacactcccaagtgtgtcgacagtggcagaggcagttggggccaaacaaaggttgattcttccattcttatctccataaagccagacctttcccttcagcactcctccacccccatctccttcttgcttttctccaactcctctaatcataggttcttccctaggacagaggggaggcgaaatgatgaggttcagagtcttccctcaaaggcgatggctgccttgagggttggagcaaaggatgatgagcaaaagacgatggtaatcagtagggaagtccagcccacttgcatctagttgcacatcttgccttgagagtaatccagtgagggtctgtcccagctaggacatcaagtaggaggggtgggttcagggttcagattcctaggaaatatgggaggagaggaaaaggcaacttggatgcacctccagcttcaggcctagcaacctgcaatgcatctcaccctgagtttgctggaatgtgtatgtatgctttgggaggaagggctgtgtgtgtattgcggggtggggtggggcagctggttccctctgacagctggacagcttgccctgaagaatttgcctgctttctggaaaaatccaactttcccaccgtgggcctgagcgtcctggtacagcaatggcgccacctgctggccttattgaggtcctactgctcagcctcagctcaatcgcctccatgttgggcttctctccctggctgccccaccctctagtccaatttctcttgtacacaaagctcatataactatagaacgtcactgttgaagagaactttaaagatacatttaattaaactcccttatggtatagttaaagacaaactaaggctcagagaagggaggtggcttgcccaatcacccagaattccaaagtcctgaatctgtagttttcccttccatcatatcatcctactcttctgccgagtcctccgtgttactccagttggatgtcatgaagccagtgtggcagtgtgaagataggtttgggacttcacttctggagcatttcatcaacataagctatcctaggcctggccagccaagcaggtcctggaggagccccaggacaaagatcacaggaggccatgaggttcggcttcttcggcgcccacagtgagcccaggaaaattagctgtagggtattacactgttgactatggagagcatatctggaattatcttcagccagattttcatctgaatggataaatgggaataccatctaagtccagataaatagatcacttccatctcatcccttctaggtagattaatcccacacttcctcttcacacaaaaccagtaataggtcatcgattttgtgcaacaggatgctgcttctcttcctaaagcccccatcgaagaggcttccagccaccattcaatcattcatcaagtcttatgatgtgccagacactgcgcgaaatgtgccagaacatctgttatgtgccagacactgttcttgagactggggatacagcaaacactcatgaagcttataattctagcagaagaggacagtaaacaatgtcatctcagtaagtatatacatgtgttttcaggattgagagctatgaaaaacataaaatatattgagaataatggttggtattttacatatggtggttacttttagaaaaataacagtggagagcacagcttcacttgaatgaagtggagaagcaggttgtatgccaagctgggagagattatcccacacaggggaaaggacaagtgcaaagccctatgatgaaaagctgccaagtgcagaaagcctcagatggcagggggcaagatggccatgaggttgtgtcagtgagtgggggtggggagaggcaggaggtcagactacatggggcctttttagttgtagattgggaagccactggagggttttgagcagagaagtcatatcatctgctttatgttttaaaaggatcatgctggctgctgagtagagaatagaggttgagggataagaaagtagaaggagaccgtagcaagaagaacgatcatggctgggagcaggtgatcatattggcagtgatgagatcaagcagaattcaaaaagtggtttcaaagtagaggtaacaggacttgctcagtctatttatttcttcaaataataatcatatttacaatgatagtagctaacagtttttgagtgcttactgtatgaaaattgagatatggtgccaatatttaaatagcatattttacttaacattcacagaaaccctgtgaagtaggttctattatctcagaaaaagaaactgaaactcagagaataacaagggactgtgttacgtgcacagtggcagaggcaaagatgaataggatgtgagtttatttgaaccccaaatgtttaaatcttggggataatacaacacacatttaaacaaagaagcaagaaaaaaaatgcacaacagaaagtgagaaataacacgaggaaagactaaatgaagtgctttgtatctagatgtgggcaggaccctttccagctgagaagatctgagactgggtcatgaacaggtggtttctgagtgggtcctgtaaaaatgaatacgattttgatgatagtaatgagtaaggacatttgagactgatagaagagtacatacaatatgtagtgatggggaaagataaggtactgtcaaaggacaatgtgttttctggtatgacagagaagtagaatgtgttaagggaagccgagtaccagaaagatccgggtgtcacagtttgtgtagggtgtttaaagctaaaccacagagtttaattttatccaatagaagaggagccacagaagagtttccatttattcattaatttattcatttattcaaaaaatatttgagtgcttattataagccaggtactatgccaggcacctgggataagacatagtcccttctgtcaagtctttacattgggtggatgtgggagggacagatgacagaacaatatgcattgagtgtaagtgctatggtataggaagctctgagtgggaggggcatggaagccgtggaagaccatggaaggcttcccaggagaagtgacgtctggactgatcctttggtcaagcaggagttaaagaggagaaaaggagagatatgggtgttcccgagagaggaagaagccttgtcccaggagcaaagtgagggtgattgttccagaaatgtgagtgattcttttaaggctcaagcaaagcatgtgattcttctttataccttctatttctttgctgagtgtttctgttcttttgtttcaagcatgctgcaattgctcattaaagcatgtttatgatggctgtctgttttaaaattcttgtcagatggtttcaacatctttatcatctcaatgttggcatctgttaatggttttttctcaatcaaattgagattttcctggttcttggtattaccagtgattttaattgcatctggaaatttgggatttatgttgaaagactggatcttattgaaagattctgtttagcacccctcctttgataccacactggtgggtccaggttccccattcagctgttgacaccttcagggcagagaggtgggatggggtgaagggggtacctcattattgctggcccaggttagaagttcaggcttcccagtagatctctgctgataccaccctggtgccatgtcattccttgagtccaaaagtccctcccaattctgccttcttctctctacatatcggagtctccctatgtttgacttatatataatgtccagggtttttagagttagttaacaggaggcataagaaaaagtgtgtccactccatcttgtctggaactggaagttcaagtcgaatataagagagaggagaggaaattacaagccatgagactggagagttaggcaggttctacaccagctattctcaaagccctcttacactcttaaaaatttagaacttcaaagagcttttgattttgaaagttacatctatcaattattactgtttcaaaaattaaaattgagaaaattttatttattaatttgtttaaaaataacaataattattcaattacatgataatgtaagtaatgcttttcttaatgaaaaataattatattttccaaaacaaaaacaattaggaaaaagagtgtcattgttttagactttggtaaatctctctaatatctggctgaagagaagaatgctgattctttttttttttttttttttttgagacggagtctcgctctgtcacccaggctggagtgtagtggtgtgatctcggctcactgcaagctctgcctcccgggttcacgccattctcctgcctcagcctcccaagtagctgggactacaggcacccgccaccacgcccggctaatttttttgtatttttagtagagatggggtttcaccgtgttagccaggctggtctcgatctcctgacctcatgatccacccacctcagcctcccaaagcgctgggattacaggtgtgagacaccgcgcccagcccccgaatgctgattcttttatctgcttctgtattcaatctgttgtgatatgatgggtagcctctgaaacactccactgtatacttgtgaaagaatgaatgtgaaaaaggaaaatagatttgtagtattattattcaaattgttttgacctcagagaccacttggaaatgttttagggaacccccagaggaccttggatcatgctttgagaaccgcggctctagatatgttactatttcagtagcatctaagtacatgtggctgctgagcacttgtaatgtggctagtgcaaatgagagacaggacttccagctatatgtaatttaataaactcaaatttaaaaactggaacctcataaaatgttttgttgttgttgttaaacatgaccttatagttttggtaggaa

SEQ ID NO: 115549 - DNA, 2874 bp, Homo sapiens
  Payload ID: 2553
  Gene Symbol: CD34
  Gene Name: CD34 molecule
  Uniprot ID: P28906
  ENST ID: ENST00000356522
  CDS Start-End: 323-1309
aagaagtgggatggggcctctccagaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggagctggaaccctgaccactcttcaggaagaaaggagtctgcacatgcagctgcaccctccctccgatccttcctcccacctccccctcccccttctcccacccctgcccccacttcctgtttgggcccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 115550 - DNA, 2538 bp, Homo sapiens
  Payload ID: 2553
  Gene Symbol: CD34
  Gene Name: CD34 molecule
  ENST ID: ENST00000367036
  CDS Start-End: 656-1339
acagagacccagttctgatgatggtcacacaccccagcagttttcccctaacaggaaagttgtcagggctgttcaggcatttccttctctgccatctgccatccggactgaagagaaagtcttagtttcaattcctttcctgttcaggggaggaggacactctgattggaggctgctggaataaattctgactcactattgaagaattatcagagtttttcttctgagtccaaattcctgggtctgatggcccagtcagcaacctgaagaaaaatctatgaacttcattaaaactgggttccatgcttttaatggaaaacagagatggaagacgagacaaaaatgccatttcagtttgagcaatgcactttttgagactcctttgggtagaaagagggaggaggccactgaggtttccactgagtgtatattatagatttgttctctcctcctcacctcccttggcttttcttccatcattggggactgctgtaatcttgaaacagaatattttctcttagttattattgcattattaatattttctgtttttggccatttcttttgagtttaatttgcatatgtgtacatgggcaatgcttcaacgagacaatttttttaagtttgttctctaacatcttagatactagaagatatggattttggtcctgggagattatttaggtttttttcttattgtgttgttgcacatatacagttagcagttttttttttttctgttggaattttagaaacaaggatccttcttgcggacggggcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 115551 - DNA, 2094 bp, Homo sapiens
  Payload ID: 2554
  Gene Symbol: CD36
  Gene Name: CD36 molecule (thrombospondin receptor)
  Uniprot ID: P16671
  ENST ID: ENST00000309881
  CDS Start-End: 414-1832
aacttgtgttaggcatgcgtccgaagagctggaaggctgaggatgtcaatggctttcagatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttgatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaa

SEQ ID NO: 115552 - DNA, 1942 bp, Homo sapiens
  Payload ID: 2554
  Gene Symbol: CD36
  Gene Name: CD36 molecule (thrombospondin receptor)
  Uniprot ID: P16671
  ENST ID: ENST00000394788
  CDS Start-End: 255-1673
atttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcc

SEQ ID NO: 115553 - DNA, 1686 bp, Homo sapiens
  Payload ID: 2554
  Gene Symbol: CD36
  Gene Name: CD36 molecule (thrombospondin receptor)
  ENST ID: ENST00000419819
  CDS Start-End: 296-1686
atgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattg

SEQ ID NO: 115554 - DNA, 545 bp, Homo sapiens
  Payload ID: 2554
  Gene Symbol: CD36
  Gene Name: CD36 molecule (thrombospondin receptor)
  ENST ID: ENST00000441034
  CDS Start-End: 33-332
cttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaag

SEQ ID NO: 115555 - DNA, 536 bp, Homo sapiens
  Payload ID: 2554
  Gene Symbol: CD36
  Gene Name: CD36 molecule (thrombospondin receptor)
  ENST ID: ENST00000436384
  CDS Start-End: 256-536
attcctggcatggtcacagtgactactgtgacttgtttgagaggtgactttgaacatttattttactttcagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacag

SEQ ID NO: 115556 - DNA, 2365 bp, Homo sapiens
  Payload ID: 2554
  Gene Symbol: CD36
  Gene Name: CD36 molecule (thrombospondin receptor)
  Uniprot ID: P16671
  ENST ID: ENST00000435819
  CDS Start-End: 685-2103
gattgcatggagacactcaggagcacaaattgcaccacggggttagtccatcacggggttagtccatccaaaagcaaggaggcagcctttggtacccctgtgccagtcaatattcattaaagggcagttttttcaaggaagtcggagctagctgctggacactaacagtcaaatctcaaaggagctgggagagaaatgcacaagcagacagggtcttgctctgttgcccaggctggagtgcagtggcgccatcacagctgctgcaacctcaacctcccaagctcaagtgaatctcccacctcagcctcccaagtagctgggactacagcaaggtttccaagaattacgttggtaggcattcaactggcatcctctggaggtaaccagatgcccagctgctcctggaggggacatatggaagtgggctcataggcggaagggacttgccttgtctcatatgaaactttggactgtggacttttgagttaacgctgaaatgagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaa
